(12) United States Patent
Chaudhary

(10) Patent No.: US 12,305,186 B2
(45) Date of Patent: May 20, 2025

(54) METHODS FOR EXPANDING SARS-COV2-ANTIGEN-SPECIFIC T CELLS, COMPOSITIONS AND USES RELATED THERETO

(71) Applicant: Angeles Therapeutics, Inc., Toluca Lake, CA (US)

(72) Inventor: Preet M. Chaudhary, Toluca Lake, CA (US)

(73) Assignee: Angeles Therapeutics, Inc., Toluca Lake, CA (US)

(*) Notice: Subject to any disclaimer, the term of this patent is extended or adjusted under 35 U.S.C. 154(b) by 0 days.

(21) Appl. No.: 17/333,005

(22) Filed: May 27, 2021

(65) Prior Publication Data

US 2021/0371822 A1 Dec. 2, 2021

Related U.S. Application Data

(60) Provisional application No. 63/030,592, filed on May 27, 2020.

(51) Int. Cl.
| | |
|---|---|
| *C12N 15/86* | (2006.01) |
| *A61K 40/11* | (2025.01) |
| *A61K 40/31* | (2025.01) |
| *A61K 40/42* | (2025.01) |
| *A61K 40/46* | (2025.01) |
| *A61K 40/50* | (2025.01) |
| *C07K 16/10* | (2006.01) |
| *C12N 5/0783* | (2010.01) |

(52) U.S. Cl.
CPC .............. *C12N 15/86* (2013.01); *A61K 40/11* (2025.01); *A61K 40/31* (2025.01); *A61K 40/4211* (2025.01); *A61K 40/46* (2025.01); *C07K 16/1003* (2023.08); *C12N 5/0636* (2013.01); *C12N 5/0638* (2013.01); *A61K 40/50* (2025.01); *A61K 2239/31* (2023.05); *A61K 2239/38* (2023.05); *A61K 2239/48* (2023.05); *C12N 2501/515* (2013.01); *C12N 2502/1114* (2013.01); *C12N 2502/99* (2013.01); *C12N 2510/00* (2013.01); *C12N 2740/15043* (2013.01)

(58) Field of Classification Search
None
See application file for complete search history.

(56) References Cited

U.S. PATENT DOCUMENTS 7,109,304 B2 9/2006 Hansen et al.

FOREIGN PATENT DOCUMENTS

WO WO-2021232048 A1 * 11/2021 ............. A61K 35/17

OTHER PUBLICATIONS

Hasan et al. A panel of artificial APCs expressing prevalent HLA alleles permits generation of cytotoxic T cells specific for both dominant and subdominant viral epitopes for adoptive therapy. J Immunol. Aug. 15, 2009;183(4):2837-50. (Year: 2009).*
Kluger HM, Dudek AZ, McCann C, Ritacco J, Southard N, Jilaveanu LB, Molinaro A, Sznol M. A phase 2 trial of dasatinib in advanced melanoma. Cancer. May 15, 2011;117(10):2202-8. doi: 10.1002/cncr.25766. Epub Nov. 29, 2010. PMID: 21523734; PMCID: PMC3116034. (Year: 2010).*
Popescu A, Anghel RM. Tyrosine-kinase Inhibitors Treatment in Advanced Malignant Melanoma. Maedica (Bucur). Dec. 2017; 12(4): 293-296. PMID: 29610594; PMCID: PMC5879586. (Year: 2017).*
Guerra N, Lanier LL. Editorial: Emerging Concepts on the NKG2D Receptor-Ligand Axis in Health and Diseases. Front Immunol. Apr. 7, 2020;11:562. doi: 10.3389/fimmu.2020.00562. PMID: 32318064; PMCID: PMC7155425. (Year: 2020).*
Baig, Abdul M., "Neurological Manifestations in COVID-19 Caused by SARS-CoV-2", CNS Neuroscience & Therapeutics, vol. 26, Mar. 14, 2020, pp. 499-501.
Bollard et al., "T Cells for Viral Infections After Allogeneic Hematopoietic Stem Cell Transplant", Blood, vol. 127, No. 26, Jun. 30, 2016, pp. 3331-3340.
Cao et al., "High-Dose Intravenous Immunoglobulin as a Therapeutic Option for Deteriorating Patients With Coronavirus Disease 2019", Open Forum Infectious Diseases, Mar. 19, 2020, pp. 1-6.
Caso et al., "Could SARS-coronavirus-2 Trigger Autoimmune And/or Autoinflammatory Mechanisms In Genetically Predisposed Subjects?", Autoimmunity Reviews, vol. 19, 2020, 3 pages.
Giavridis et al., "CAR T Cell-Induced Cytokine Release Syndrome is Mediated by Macrophages and Abated by IL-1 Blockade", Nature Medicine, vol. 24, No. 6, Jun. 2018, 19 pages.
Hill et al., "CAR-T-and a Side Order of IgG, to Go?—Immunoglobulin Replacement in Patients Receiving CAR-T Cell Therapy", Blood Reviews, vol. 38, Nov. 2019, 25 pages.
Humar et al., "Elevated Serum Cytokines Are Associated With Cytomegalovirus Infection and Disease in Bone Marrow Transplant Recipients", The Journal of Infectious Diseases, vol. 179, No. 2, Feb. 1999, 1 page.
Iannaccone et al., "Weathering the Cytokine Storm in COVID-19: Therapeutic Implications", CardioRenal Medicine, vol. 10, Jun. 29, 2020, 11 pages.

(Continued)

*Primary Examiner* — Allison M Fox
*Assistant Examiner* — Alyssa G Weston
(74) *Attorney, Agent, or Firm* — IPath PLC; Steven J. Miller, Esq.

(57) ABSTRACT

Provided herein are methods for preparing and characterizing SARS-co2 antigen specific immune cell cultures and preparations and methods of using the same in adoptive immunotherapy for cancer, infections and immune disorders. Also, provided are compositions and methods for generating immune cells expressing synthetic antigen binding receptors targeting SARS-cov2 and methods of use of these cells for the treatment and prevention of COVID-19. Also provided are compositions and methods for determining immune response to SARs-cov2 in a subject, detecting SARS-cov2, measuring cytotoxicity induced by SARS-cov2, and detecting the expression and cytotoxicity of synthetic antigen binding receptors targeting SARS-cov2.

18 Claims, No Drawings

Specification includes a Sequence Listing.

(56) References Cited

OTHER PUBLICATIONS

Mclaughlin et al., "Adoptive T Cell Therapy for Epstein-Barr Virus Complications in Patients With Primary Immunodeficiency Disorders", Frontiers in Immunology, vol. 9, No. 556, Mar. 2018, 7 pages.
Moore et al., "Cytokine Release Syndrome in Severe COVID-19", Science, vol. 368, No. 6490, May 1, 2020, pp. 473-474.
Neelapu et al., "Chimeric Antigen Receptor T-cell Therapy—Assessment and Management of Toxicities", Nature Reviews Clinical Oncology, vol. 15, No. 1, Jan. 2018, 37 pages.
Riphagen et al., "Hyperinflammatory Shock in Children During Covid-19 Pandemic", Correspondence, vol. 395, No. 10237, May 23, 2020, pp. 1607-1608.
Rodríguez et al., "Autoinflammatory and Autoimmune Conditions at the Crossroad of COVID-19", Journal of Autoimmunity, vol. 114, 2020, 19 pages.
Shi et al., "Successful Treatment With Plasma Exchange Followed by Intravenous Immunoglobulin in a Critically Ill Patient With COVID-19", International Journal of Antimicrobial Agents, vol. 56, 2020, 5 pages.
Toscano et al., "Guillain-Barré Syndrome Associated With SARS-CoV-2", The New England Journal Of Medicine, Apr. 17, 2020, 3 pages.
Weiss et al., "Clinical Course and Mortality Risk of Severe COVID-19", vol. 395, Mar. 16, 2020, 3 pages.
Zhao et al., "Guillain-Barré Syndrome Associated With SARS-CoV-2 Infection: Causality or Coincidence?", Lancet Neurology, vol. 19, Apr. 1, 2020, pp. 383-384.
Zhou et al., "Clinical and Autoimmune Characteristics of Severe and Critical Cases of COVID-19", Clinical and Translational Science, vol. 13, 2020, pp. 1077-1086.
Zulfiqar et al., "Immune Thrombocytopenia Purpura in a Patient With COVID-19", The New England Journal Of Medicine, Apr. 15, 2020, 2 pages.

\* cited by examiner

METHODS FOR EXPANDING SARS-COV2-ANTIGEN-SPECIFIC T CELLS, COMPOSITIONS AND USES RELATED THERETO

CROSS REFERENCE TO RELATED APPLICATIONS

The application claims priority under 35 U.S.C. § 119 to U.S. Provisional Application Ser. No. 63/030,592, filed May 27, 2020, the disclosures of which are incorporated herein by reference.

TECHNICAL FIELD

The disclosure provides methods for preparing and characterizing SARS-co2 antigen specific immune cell cultures and preparations and methods of using the same in adoptive immunotherapy for cancer, infections and immune disorders.

INCORPORATION BY REFERENCE OF SEQUENCE LISTING

Accompanying this filing is a Sequence Listing entitled "Sequence-Listing_ST25.txt", created on May 27, 2021 and having 3,708,371 bytes of data, machine formatted on IBM-PC, MS-Windows operating system. The sequence listing is hereby incorporated herein by reference in its entirety for all purposes.

BACKGROUND

Adoptive immunotherapy involves implanting or infusing disease-specific and/or engineered T cells, such as antigen-specific cytotoxic cells (CTLs) and synthetic antigen binding receptor (SABR)-expressing T cells, into individuals with the aim of recognizing, targeting, and destroying disease-associated cells.

CARs are synthetic immune-receptors, which can redirect T cells to selectively kill tumor cells. To overcome some of the design limitation of conventional 2nd generation CARs, several alternative designs, collectively termed next generation CARs, have been described, including Ab-TCR (WO 2017/070608 A1 incorporated herein by reference), TCR receptor fusion proteins or TFP (WO 2016/187349 A1 incorporated herein by reference), Synthetic Immune Receptors (SIRS) (see, WO 2018/102795 A1, incorporated herein by reference), Tri-functional T cell antigen coupler (Tri-TAC) (see, WO 2015/117229 A1, incorporated herein by reference) and zSIR (see WO2019232503, incorporated herein by reference). The term SABR as described herein comprise single chain immune receptors (e.g., $1^{st}$, $2^{nd}$ and $3^{rd}$ generation synthetic antigen binding receptors, TFPs, Tri-TAC and the like) and multiple chain immune receptors (e.g., SIR, zSIR, cTCR, ab-TCRs, αβTFP, γdTFP, recombinant TCRs, SAR etc.). SABR are capable of recognizing their target antigen in MHC-dependent and MHC-independent manner. SABRs are synthetic receptors typically consisting of a targeting/binding moiety that is associated with one or more signaling domains in one or more fusion molecules.

The proliferation and persistence of SABR-T cells in vivo is an important factor in treatment efficacy. To this end, we herein describe methods for the generation and/or production of autologous and allogeneic antigen-specific T cells (e.g., T cells specifically sensitized to detect, for example, SARS-cov2-associated antigen(s)), and have also been engineered to express at least one functional synthetic antigen binding receptor directed against a disease-associated antigen of choice.

SUMMARY OF THE INVENTION

Provided herein are methods of generating allogeneic or autologous T cells that express a T cell receptor that specifically binds to an antigen (e.g., a virus antigen such as an SARS-cov2 peptide) presented on a major histocompatibility complex (MHC) and a synthetic antigen binding receptor (SABR) that specifically binds to a target-cell antigen or cell surface marker (e.g., a cancer cell-associated antigen such as CD 19). In some embodiments, the antigen-specific T cells are generated by incubating a sample comprising T cells (responder cells, e.g., a PBMC sample or T cells isolated therefrom) with antigen presenting cells (APCs, i.e., stimulator cells) presenting an antigen (e.g., viral peptide) on an MHC (e.g., a class I MHC encoded by an allele that is present in the subject), thereby inducing proliferation of antigen-specific responder T cells. Preferably, the antigen-specific responder T cells are transduced with a viral vector comprising a nucleic acid sequence encoding a SABR. Also provided herein are methods for inducing ex vivo proliferation of a population of SABR-expressing antigen-specific T cells, comprising culturing a population of isolated T cells with antigen-presenting stimulator cells and transducing the resultant antigen-specific T cells with a viral vector comprising a nucleic acid sequence encoding a SABR. In some embodiments, the transduced T cells are cultured with the antigen-presenting stimulator cells to induce proliferation of antigen-specific SABR T cells. In certain other embodiments, the isolated T cells are transduced with a SABR-encoding viral vector prior to culturing with APCs. In yet further embodiments, the isolated T cells are cultured with APCs prior to and following transduction with a SABR-encoding viral vector.

In some aspects, provided herein are ex vivo methods for enriching central memory T cells. In certain embodiments, such methods comprise obtaining a sample of cells from a subject comprising CD3+ T cells and contacting said CD3+ T cells with antigen-presenting stimulator cells. In preferred embodiments, the CD3+ T cells are isolated from the sample prior to contacting the antigen-presenting stimulator cells by methods known in the art (e.g., positive selection of CD3+ cells from the sample and/or negative selection by depletion of undesired cells or components from the sample). For example, and without limitation, such methods include selection with anti-CD3 beads (e.g., magnetic beads), plastic adherence, elutriation, depletion of NK cells (e.g., using anti-CD56 beads), and/or combinations thereof. In some such embodiments, the CD3+ T cells are transduced with a viral vector encoding a synthetic antigen binding receptor (SABR) before and/or after contact with the antigen-presenting stimulator cells. In some such embodiments the SABR-expressing, CD3+, antigen-specific T cells are cultured with antigen-presenting stimulator cells.

In some embodiments, the stimulator cells are made to present at least one virus peptide antigen by incubating the intended stimulator cells with one or more of the virus peptides. In some embodiments, the virus is SARS-cov2.

The disclosure also provides isolated nucleic acids, polypeptides and vectors encoding SABR, wherein the antigen specific domain of the SABR targets the spike glycoprotein of SARS-cov2. The disclosure also provides cells and cell populations (such as T cells, NK cells, iPSC) comprising vectors encoding nucleic acids encoding SABR, wherein the antigen specific domain of the SABR targets spike glycoprotein of SARS-cov2.

The disclosure also provides isolated nucleic acids, isolated polypeptides, vectors and kits for a fast, economical, sensitive and specific assay for detection of antibodies, antibody fragments and non-immunoglobulin antigen binding domains targeting the Spike glycoprotein of SARS-cov2.

DETAILED DESCRIPTION

Definitions

For convenience, certain terms employed in the specification, examples, and appended claims are collected here.

The term "antigen" or "Ag" refers to a molecule that provokes an immune response. This immune response may involve either antibody production, or the activation of specific immunologically-competent cells, or both.

The term "antigen presenting cell" or "APC" refers to an immune system cell such as an accessory cell (e.g., a B-cell, a dendritic cell, and the like) that displays a foreign antigen complexed with major histocompatibility complexes (WIC's) on its surface.

An "antigen binding domain" or "antigen binding module" or "antigen binding segment" or "antigen specific domain" (ASD) refers to a polypeptide or peptide that due to its primary, secondary or tertiary sequence, post-translational modifications and/or charge binds to an antigen with a high degree of specificity.

The term "Ab-TCR" or "AbTCR" refers to a next generation CAR platform as described in WO 2017/070608 A1 which is incorporated herein by reference.

The term "accessory module" refers to any molecule that is expressed in an immune cell (e.g., T cell, e.g., SABR-T cell, e.g., CAR-T cell or TCR-T cell) to decrease, regulate or modify the activity of the immune cell.

As used herein, the term "backbone" or "architecture" refers to the configuration of the different components (e.g., antigen binding domains, hinge domains, transmembrane domains, signaling domains) that comprise different SABR (e.g., CAR, SIR, cTCR, Ab-TCR, TFP etc.) and any accessory module which is generally optional.

Table A1: Exemplary SABR architectures. First generation conventional CARs (Conventional CAR I) have an intracellular signaling (ISD) domain (e.g. CD3z) and no costimulatory domain. The TCR fusion proteins (TFP) are another example of conventional CAR 1. Second generation conventional CARs (Conventional CAR 2 or CAR II) have one costimulatory domain (e.g. 41BB or CD28) and an intracellular signaling (ISD) domain (e.g. CD3z). Third generation conventional CARs (Conventional CAR 3 or CAR III) have two costimulatory domains (e.g. 41BB and CD28) and an intracellular signaling (ISD) domain (e.g. CD3z). Ab-TCRs are duel chain receptors incorporating a vL-linker-TCR domain (TCRD and a vH-linker-TCR domain (TCRD) and have been described in PCT/US2016/058305. cTCRs are single chain, one-and-half, or double chain receptors consisting of antigen binding domain derived from a vL and vH fragment that are fused to one or more TCR constant chain (TCR-C) and result in activation of T cell signaling. Exemplary configurations of cTCR are described in PCT/US2017/064379 or WO 2018/102795 A1. Synthetic immune receptors are next generation SABR and are described in PCT/US2017/064379 or WO 2018/102795 A1. zSIRs are double chain receptors comprising two CD3z chains or fragments thereof with optional linkers and are described in PCT/US2019/035096. SABR may target a single antigen, two antigens or multiple antigens. SABR may target the single epitope of a single antigen or two or more epitopes of one or more antigens. The present disclosure covers unispecific, bispecific, multispecific, uni-paratopic, bi-paratopic and multi-paratopic SABRs.

TABLE A1

Exemplary SABR Architectures

| | | | | | | |
|---|---|---|---|---|---|---|
| 1 | CAR 1 or CAR I (including TFP) | ASD | HR | TMD | ISD | |
| 2 | CAR 2 (CAR II) | ASD | HR | TMD | CSD | ISD |
| 3 | CAR 3 (CAR III) | ASD | HR | TMD | CSD-I | CSD-II | ISD |
| 4 | Ab-TCR | vL-cL | TCRD(1) | 2A | vH-CH1 | TCRD (II) |
| 5 | Double Chain cTCR/SIR-1 | vL | TCR-C(1) | 2A | vH | TCR-C (II) |
| 6 | Double Chain zSIR | vL-linker | CD3z | 2A | vH-linker | CD3z |
| 6 | One & Half Chain cTCR/SIR-3 | | TCR-C(1) | 2A | ASD | TCR-C (II) |

TABLE 1

| SEQ ID NO | Name of vector or component | SEQ ID NO | |
|---|---|---|---|
| 1 | pLenti-EF1a | 11 | pLENTI-NLuc-AcV5-Blasticidin-Pa08 |
| 2 | pLenti-EF1a-DWPRE | 12 | pLENTI-Gluc-Flag-blast-B07 |
| 3 | MSCV-Bgl2-AvrII-Bam-EcoR1-Xho-BstB1-Mlu-Sal-ClaI.I03 | 13 | PolyA |
| 4 | pCCLc-MNDU3-WPRE | 14 | PolyA |
| 5 | pCCLc-MNDU3-Eco-Nhe-Sal-WPRE | 15 | PolyA |
| 6 | pCCLc-MNDU3-delta-WPRE | 16 | polyA |
| 7 | EF1alpha_(EF1a)_Promoter_Variant | 17 | pCDNA3 |

TABLE 1-continued

| SEQ ID NO | Name of vector or component | SEQ ID NO | |
|---|---|---|---|
| 8 | pSBbi-Pur | 18 | DNA barcode 11 |
| 9 | MSCVhygro-GLuc-HA-G02 | 19 | DNA barcode 12 |
| 10 | MSCVpac-GLUC-R03 | 20 | DNA barcode 13 |

TABLE 2

| NAME | SEQ ID NO (DNA) | SEQ ID NO (PRT) |
|---|---|---|
| LucPPe-146-1H2 | 21 | 491 |
| LucPPe-133-1B2 | 22 | 492 |
| LucPPe-78-0B10 | 23 | 493 |
| LucPPe49-7C6A | 24 | 494 |
| LucPpL-81-6G1 | 25 | 495 |
| GLuc | 26 | 496 |
| NLuc | 27 | 497 |
| TLuc | 28 | 498 |
| MLuc7-M43L/M110L | 29 | 499 |
| LoLuc | 30 | 500 |
| HtLuc | 31 | 501 |
| PaLuc1 | 32 | 502 |
| PaLuc2 | 33 | 503 |
| MpLuc1 | 34 | 504 |
| McLuc1 | 35 | 505 |
| MaLuc1 | 36 | 506 |
| MoLuc1 | 37 | 507 |
| MoLuc2 | 38 | 508 |
| MLuc39 | 39 | 509 |
| PsLuc1 | 40 | 510 |
| LoLuc1-3 | 41 | 511 |
| HtLuc2 | 42 | 512 |
| Renilla-Luc | 43 | 513 |

TABLE 3

| NAME | SEQ ID NO (DNA) | SEQ ID NO (PRT) |
|---|---|---|
| CD8_Signal_Peptide | 45 | 515 |
| CD8-SIGNAL-PEPTIDE | 46 | 516 |
| IgH_Signal_Peptide | 47 | 517 |
| IgH_Signal_Peptide | 48 | 518 |
| (GGGGS)x3-Linker | 56 | 526 |
| (GGSG)7_Linker | 57 | 527 |
| (GGSG)7_Linker_2 | 58 | 528 |
| DDAKK_linker | 59 | 529 |

TABLE 4

Exemplary Tags and Linkers

| Name of fragment | SEQ ID NO (DNA) | SEQ ID NO (PRT) |
|---|---|---|
| G4S | 61 | 531 |
| G3Sx2 | 62 | 532 |
| G4Sx2 | 63 | 533 |
| G4Sx3 | 64 | 534 |
| Myc-(P)-TAG | 65 | 535 |
| MYC2-TAG | 66 | 536 |
| MYC4-TAG | 67 | 537 |
| V5-TAG | 68 | 538 |

TABLE 5

Exemplary SABR components

| Name of fragment | SEQ ID NO (DNA) | SEQ ID NO (PRT) |
|---|---|---|
| hTCR-alpha-constant_X02883.1 | 78 | 548 |
| hTCRa-WT | 79 | 549 |
| hTCRa-CSDVP | 80 | 550 |
| hTCRa-opt2 | 81 | 551 |
| hTCRa-opt3 | 82 | 552 |
| hTCRa-T48C-opt | 83 | 553 |
| hTCRa-T48C-opt1 | 84 | 554 |
| hTCRa-SDVP | 85 | 555 |
| hTCRa-S61R | 86 | 556 |
| hTCRa-SDVPR | 87 | 557 |
| hTCRa-SD | 88 | 558 |
| hTCRaECD-CD3zECDTMCP-opt2 | 89 | 559 |
| mTCRa-opt | 90 | 560 |
| cTCRa-opt | 91 | 561 |
| hTCR-b1-constant-region_X00437.1 | 92 | 562 |
| hTCR-b2-constant-region_L34740 | 93 | 563 |
| hTCRb-WT | 94 | 564 |
| hTCRb-S57C-opt1 | 95 | 565 |
| hTCRb-KACIAH | 96 | 566 |
| 41BB-CP-opt2 | 134 | 604 |
| CD3zECDTM-28z-opt | 135 | 605 |
| CD3zECDTM-BBz-opt | 136 | 606 |
| CD3zECDTM-28z-opt2 | 137 | 607 |
| CD3zECDTM-BBz-opt2 | 138 | 608 |
| TCRa-wt2-opt-6MD | 139 | 609 |
| TCRb-wt2-opt-6MD | 140 | 610 |
| TCRg-6MD | 141 | 611 |
| TCRd-6MD | 142 | 612 |
| IgCL | 143 | 613 |
| IgG1-CH1 | 144 | 614 |
| IgG1-CH1-DeltaC | 145 | 615 |
| IgG1-CH1-Hinge | 146 | 616 |
| IgG1-CH1-v2 | 147 | 617 |
| IgG1-CH1-DeltaC-v2 | 148 | 618 |
| IgG1-CH1-Hinge-v2 | 149 | 619 |
| IgG2-0C-CH1 | 150 | 620 |
| IgG2-IC-CHI1 | 151 | 621 |
| IgG3-CHI1 | 152 | 622 |

TABLE 6

Therapeutic Controls

| Name of fragment | SEQ ID NO (DNA) | SEQ ID NO (PRT) |
|---|---|---|
| PuroR_Variant-(PAC) | 190 | 660 |
| BlastR | 191 | 661 |
| CNB30 | 192 | 662 |
| GMCSF-SP-tEGFR | 193 | 663 |
| tEGFRviii | 194 | 664 |
| tCD19 | 195 | 665 |
| tBCMA | 196 | 666 |
| K13 | 197 | 667 |
| MC159 | 198 | 668 |
| K13-opt | 199 | 669 |
| icaspase-9 | 200 | 670 |

TABLE 7A

| SARS-cov2 vL, vH and ScFv | | | | | |
|---|---|---|---|---|---|
| Name of fragment | SEQ ID NO (DNA) | SEQ ID NO (PRT) | CDR1 | CDR2 | CDR3 |
| SARS-cov2-vL | | | | | |
| SARScov2-CR3022-vL | 213 | 683 | 960 | 961 | 962 |
| SARScov2-S-RBD-B38-vL | 214 | 684 | 963 | 964 | 965 |
| SARS-cov2-S-RBD-H4-vL | 215 | 685 | 966 | 967 | 968 |
| SARS-cov2-vH | | | | | |
| SARScov2-CR3022-vH | 217 | 687 | 970 | 971 | 972 |
| SARScov2-S-RBD-B38-vH | 218 | 688 | 973 | 974 | 975 |
| SARS-cov2-S-RBD-H4-vH | 219 | 689 | 976 | 977 | 978 |
| SARS-cov2-scFv | | | | | |
| SARScov2-CR3022-scFv | 221 | 691 | | | |
| SARScov2-S-RBD-B38-scFv | 222 | 692 | | | |
| SARS-cov2-S-RBD-H4-scFv | 223 | 693 | | | |

TABLE 7B

| SARS-cov2 | | |
|---|---|---|
| Name of fragment | SEQ ID NO (DNA) | SEQ ID NO (PRT) |
| SARS-cov2-Poly-epitopes and Polypeptides | | |
| SARS-cov2-Spike-Glycoprotein-S2 | 224 | 694 |
| SARScov2-HLA-A0201-Polypeptides | 225 | 695 |
| Ub-G76A-SARScov2-HLA-A0201-Polyepitopes | 226 | 696 |
| SARScov2-HLA-DRB10401-Polyepitopes | 227 | 697 |
| Ub-G76A-SARScov2-HLA-DRB10401-Polyepitopes | 228 | 698 |
| CD8SP-StreptagII-R1-S-Protein-RBD-Mlu-mCD8-hinge-TM | 229 | 699 |
| SARS-cov2 and Relevant Cellular Proteins | | |
| SARS-cov2-Spike-Glycoprotein-1-RBD (S1-RBD) | 230 | 700 |
| SARS-cov2-Spike-Glycoprotein | 231 | 701 |
| SARS-cov2-nucleocapside-phosphoprotein | 232 | 702 |
| SARS-cov2-membrane-glycoprotein | 233 | 703 |
| orf3a | 234 | 704 |
| ACE2 | 235 | 705 |
| TMPRSS2 | 236 | 706 |
| SARS-cov2-Spike-Glycoprotein-S1-ND1 | 237 | 707 |
| SARS-cov2-Spike-Glycoprotein-S1-ND2 | 242 | 712 |
| SARS-cov2-Spike-Glycoprotein-S2 | 224 | 694 |
| MALIBU-Glo Reagents | | |
| CD8SP-hu-mROO5-1-(vL-vH)-GGSG-NLuc-4xFLAG-x2STREP-8xHis-T2A-PAC | 238 | 708 |
| CD8SP-SARScov2-CR3022-(vL-vH)-GGSG-NLuc-4xFLAG-x2STREP-8xHis-T2A-PAC | 239 | 709 |
| CD8SP-SARS-cov2-S-RBD-H4-(vL-vH)-GGSG-NLuc-4xFLAG-x2STREP-8xHis-T2A-PAC | 240 | 710 |
| CD8SP-SARScov2-S-RBD-B38-(vL-vH)-GGSG-NLuc-4xFLAG-x2STREP-8xHis-T2A-PAC | 241 | 711 |
| Topanga Reagents | | |
| CD19-ECD-GGSG-NLuc-4xFlag-2xStreptag-8xHis-T2A-Pac | 243 | 713 |
| CD33-ECD-GGSG-NLuc-4xFlag-2xStreptag-8xHis-T2A-Pac | 244 | 714 |
| CD8SP-BCMA-ECD-GGSG-NLuc-4xFlag-2xStreptag-8xHis-T2A-Pac | 245 | 715 |
| CD8SP-StreptagII-R1-S1-Protein-RBD-ECD-GGSG-NLuc-4xFlag-2xStreptag-8xHis-T2A-Pac | 246 | 716 |
| CD8SP-R1-S1-Protein-RBD-ECD-GGSG-NLuc-4xFlag-2xStreptag-8xHis-T2A-Pac | 247 | 717 |
| S-Protein-ECD-GGSG-NLuc-4xFlag-2xStreptag-8xHis | 248 | 718 |
| SARS-cov2-nucleocapsid-GGS-NLuc-4xFlag-2xStreptag-8xHis-T2A-PAC | 249 | 719 |
| orf3a-GGSG-NLuc-4xFlag-2xStreptag-8xHis | 250 | 720 |
| ACE2-ECD-GGS-NLuc-4xFlag-2xStreptag-8xHis | 251 | 721 |

TABLE 8

Exemplary SABR Targeting CD19

| Name of fragment | SEQ ID NO (DNA) | SEQ ID NO (PRT) |
|---|---|---|
| CD8SP-hu-mROO5-1-vL-Gly-Ser-Linker-hu-mROO5-1-vH-Myc-CD8TM-BBz-T2A-PAC | 253 | 723 |
| CD8SP-hu-mROO5-1-vL-Gly-Ser-Linker-hu-mROO5-1-vH-Myc-28z-T2A-PAC | 254 | 724 |
| CD8SP-hu-mROO5-1-vL-Gly-Ser-Linker-hu-mROO5-1-vH-Myc-28z | 255 | 725 |
| CD8SP-hu-mROO5-1-vL-Gly-Ser-Linker-hu-mROO5-1-vH-Myc-CD8TM-BBz | 256 | 726 |
| CD8SP-hu-mROO5-1-vH-Gly-Ser-Linker-vL-Myc-CD8TM-BBz | 257 | 727 |
| CD8SP-hu-mROO5-1-vL-Gly-Ser-Linker-hu-mROO5-1-vH-Myc-CD8TM-z-P2A-K13-FLAG-T2A-PAC | 258 | 728 |
| CD8SP-hu-mROO5-1-vL-[hTCRa-CSDVP]-F-F2A-SP-hu-mROO5-1-vH-[hTCRb-KACIAH]-F-P2A-PAC | 259 | 729 |
| CD8SP-hu-mROO5-1-vL-[hTCRb-KACIAH]-F-F2A-SP-hu-mROO5-1-vH-[hTCRa-CSDVP]-F-P2A-PAC | 260 | 730 |
| CD8SP-hu-mROO5-1-vL-[hTCRb-S57C]-F-F2A-SP-hu-mROO5-1-vH-[hTCRa-T48C] | 261 | 731 |
| CD8SP-hu-mROO5-1-vL-[hTCRb-S57C]-F-F2A-SP-hu-mROO5-1-vH-[hTCRa-T48C]-F-F2A-K13-opt | 262 | 732 |
| CD8SP-hu-mROO5-1-vL-[hTCRa-T48C]-F-F2A-SP-hu-mROO5-1-vH-[hTCRb-S57C] | 263 | 733 |
| CD8SP-hu-mROO5-1-vL-[hTCRa-T48C]-F-F2A-SP-hu-mROO5-1-vH-[hTCRb-S57C]-F-P2A-K13-opt | 264 | 734 |
| CD8SP-V5-[hTCRb-KACIAH]-F-P2A-CD8SP-hu-mROO5-1-vL-Gly-Ser-Linker-hu-mROO5-1-vH-Myc-[hTCRa-CSDVP]-F-F2A-PAC | 265 | 735 |
| CD8SP-MYC-[hTCRa-T48C-opt1]-F-F2A-SP-hu-mROO5-1-vL-Gly-Ser-Linker-hu-mROO5-1-vH-V5-[hTCRb-S57C-opt1]-F-P2A-PAC | 266 | 736 |
| CD8SP-hu-mROO5-1-vL-[hTCRb-opt2]-F-P2A-SP-hu-mROO5-1-vH-[hTCRa-opt2]-F-F2A-PAC | 267 | 737 |
| CD8SP-hu-mROO5-1-vL-[hTCRb-opt2]-F-P2A-SP-hu-mROO5-1-vH-Myc-[preTCRa-Del48]-F-F2A-PAC | 268 | 738 |
| CD8SP-[hTCRb-opt2]-F-P2A-CD8SP-hu-mROO5-1-vL-Gly-Ser-Linker-hu-mROO5-1-vH-Myc4-[preTCRa-Del48]-F-F2A-PAC | 269 | 739 |
| CD8SP-hu-mROO5-1-vL-V5-[hTCRg1-opt]-F-P2A-SP-hu-mROO5-1-vH-Myc-[hTCRd-opt]-F-P2A-PAC | 270 | 740 |
| CD8SP-hu-mROO5-1-vL-[hTCRd-opt]-F-P2A-SP-hu-mROO5-1-vH-[hTCRg1-opt] | 271 | 741 |
| CD8SP-V5-[hTCRg1-opt]-F-P2A-CD8SP-hu-mROO5-1-vL-Gly-Ser-Linker-hu-mROO5-1-vH-Myc-[hTCRd-opt]-F-P2A-PAC | 272 | 742 |
| CD8SP-hu-mROO5-1-vL-IgCL-Bam-CD3zECDTMCP-opt-F-P2A-Spe-SP-Bst-hu-mROO5-1-vH-IgG1-CH1-KPN-CD3zECDTMCP-opt2-F-F2A-Xba-PAC | 273 | 743 |
| CD8SP-hu-mROO5-1-vL-[hTCRbECD-Bam-CD3zECDTMCP-opt]-F-P2A-SP-hu-mROO5-1-vH-[hTCRaECD-Kpn-CD3zECDTMCP-opt2] | 274 | 744 |
| CD8SP-hu-mROO5-1-vL-[hTCRb-KAC-ECD-Bam-CD3zECDTMCP-opt]-F-P2A-SP-hu-mROO5-1-vH-[hTCRa-CSDVP-ECD-Kpn-CD3zECDTMCP-opt2] | 275 | 745 |
| CD8SP-hu-mROO5-1-vL-V5-[hTCRbECD-Bam-CD3zECDTMCP-opt]-F-P2A-SP-hu-mROO5-1-vH-Myc-[hTCRaECD-Kpn-CD3zECDTM-28z-opt2] | 276 | 746 |
| CD8SP-hu-mROO5-1-vL-V5-[hTCRbECD-Bam-CD3zECDTM-28z-opt]-F-P2A-SP-hu-mROO5-1-vH-Myc-[hTCRaECD-Kpn-CD3zECDTM-28z-opt2] | 277 | 747 |
| CD8SP-hu-mROO5-1-vL-V5-[hTCRbECD-Bam-CD3zECDTMCP-opt]-F-P2A-SP-hu-mROO5-1-vH-Myc4-[hTCRaECD-Kpn-CD3zECDTM-BBz-opt2] | 278 | 748 |
| CD8SP-hu-mROO5-1-vL-V5-[hTCRbECD-Bam-CD3zECDTM-BBz-opt]-F-P2A-SP-hu-mROO5-1-vH-Myc4-[hTCRaECD-Kpn-CD3zECDTM-BBz-opt2] | 279 | 749 |
| CD8SP-hu-mROO5-1-vL-CD3zECDTMCP-opt-F-P2A-Spe-SP-Bst-hu-mROO5-1-vH-Mlu-CD3zECDTMCP-opt2-F-F2A-PAC | 280 | 750 |
| CD8SP-hu-mROO5-1-vL-[IgCL-TCRg-6MD]-F-P2A-SP-hu-mROO5-1-vH-[IgG1-CH1-TCRd-6MD] | 281 | 751 |
| CD8SP-hu-mROO5-1-vL-[IgCL-TCRb-IAH-6MD]-F-P2A-SP-hu-mROO5-1-vH-[IgG1-CH1-TCRa-SDVP-6MD] | 282 | 752 |
| CD8SP-hu-mROO5-1-vL-[IgCL-TCRb-wt-opt2-6MD]-F-P2A-SP-hu-mROO5-1-vH-[IgG1-CH1-TCRa-wt-op2-6MD] | 283 | 753 |
| CD8SP-hu-mROO5-1-(vL-vH)-CD3e-ECDTMCP-opt2 | 284 | 754 |
| CD8SP-hu-mROO5-1-(vL-vH)-CD3d-ECDTMCP-opt2 | 285 | 755 |
| CD8SP-hu-mROO5-1-(vL-vH)-CD3g-ECDTMCP-opt2 | 286 | 756 |
| CD8SP-hu-mROO5-1-(vL-vH)-CD3z-ECDTMCP-opt2 | 287 | 757 |
| CD8SP-hu-mROO5-1-(vH-vL)-CD3e-ECDTMCP-opt2 | 288 | 758 |
| CD8SP-hu-mROO5-1-(vH-vL)-CD3d-ECDTMCP-opt2 | 289 | 759 |
| CD8SP-hu-mROO5-1-(vH-vL)-CD3g-ECDTMCP-opt2 | 290 | 760 |
| CD8SP-hu-mROO5-1-(vH-vL)-CD3z-ECDTMCP-opt2 | 291 | 761 |
| CD8SP-hu-mROO5-1-vL-Gly-Ser-Linker-hu-mROO5-1-vH-[hTCRa-opt2]-F-F2A-PAC | 292 | 762 |

TABLE 8-continued

Exemplary SABR Targeting CD19

| Name of fragment | SEQ ID NO (DNA) | SEQ ID NO (PRT) |
|---|---|---|
| CD8SP-hu-mROO5-1-vL-Gly-Ser-Linker-hu-mROO5-1-vH-[hTCRb-opt2]-F-F2A-PAC | 293 | 763 |
| CD8SP-hu-mROO5-1-vL-Gly-Ser-Linker-hu-mROO5-1-vH-Myc4-[preTCRa-Del48]-F-F2A-PAC | 294 | 764 |
| CD8SP-hu-mROO5-1-vL-[hTCRb-opt2]-F-P2A-PAC | 295 | 765 |
| CD8SP-hu-mROO5-1-vL-[hTCRb-opt2] | 296 | 766 |
| IgHSP-hu-mROO5-1-vH-[hTCRa-opt2]-F-F2A-BlastR | 297 | 767 |
| IgHSP-hu-mROO5-1-vH-[hTCRa-opt2] | 298 | 768 |
| CD8SP-hu-mROO5-1-vL-V5-[hTCRb-S57C-opt]-F-P2A-PAC | 299 | 769 |
| CD8SP-hu-mROO5-1-vL-V5-[hTCRb-S57C-opt] | 300 | 770 |
| IgHSP-hu-mROO5-1-vH-Myc-[hTCRa-T48C-opt]-F-F2A-BlastR | 301 | 771 |
| IgHSP-hu-mROO5-1-vH-Myc-[hTCRa-T48C-opt] | 302 | 772 |
| CD8SP-hu-mROO5-1-vL-Gly-Ser-Linker-hu-mROO5-1-vH-[hTCRa-SDVP]-F-F2A-PAC | 303 | 773 |
| CD8SP-hu-mROO5-1-vL-Gly-Ser-Linker-hu-mROO5-1-vH-[hTCRb-KAIAH]-F-P2A-PAC | 304 | 774 |
| CD8SP-hu-mROO5-1-(vL-vH)-G4S-CD3e-ECDTMCP-opt2-F-F2A-PAC | 305 | 775 |
| CD8SP-hu-mROO5-1-(vL-vH)-G4S-CD3d-ECDTMCP-opt2-F-F2A-PAC | 306 | 776 |
| CD8SP-hu-mROO5-1-(vL-vH)-G4S-CD3g-ECDTMCP-opt2-F-F2A-PAC | 307 | 777 |
| CD8SP-hu-mROO5-1-(vL-vH)-G4S-CD3z-ECDTMCP-opt2-F-F2A-PAC | 308 | 778 |

TABLE 9

Exemplary SABR Targeting SARS-cov2 S-RBD

| Name of fragment | SEQ ID NO (DNA) | SEQ ID NO (PRT) |
|---|---|---|
| CD8SP-SARScov2-CR3022-vL-GS-linker-SARScov2-CR3022-vH-CD8TM-BBz | 309 | 779 |
| CD8SP-SARScov2-CR3022-vL-GS-linker-SARScov2-CR3022-vH-Myc-CD8TM-BBz-T2A-PAC | 310 | 780 |
| CD8SP-SARScov2-CR3022-vL-GS-linker-SARScov2-CR3022-vH-Myc-28z-T2A-PAC | 311 | 781 |
| CD8SP-SARScov2-CR3022-vL-GS-linker-SARScov2-CR3022-vH-Myc-28z | 312 | 782 |
| CD8SP-SARScov2-CR3022-vL-GS-linker-SARScov2-CR3022-vH-Myc-CD8TM-BBz | 313 | 783 |
| CD8SP-SARScov2-CR3022-vH-GS-linker-vL-Myc-CD8TM-BBz | 314 | 784 |
| CD8SP-SARScov2-CR3022-vL-GS-linker-SARScov2-CR3022-vH-Myc-CD8TM-z-P2A-K13-FLAG-T2A-PAC | 315 | 785 |
| CD8SP-SARScov2-CR3022-vL-[hTCRa-CSDVP]-F-F2A-SP-SARScov2-CR3022-vH-[hTCRb-KACIAH]-F-P2A-PAC | 316 | 786 |
| CD8SP-SARScov2-CR3022-vL-[hTCRb-KACIAH]-F-F2A-SP-SARScov2-CR3022-vH-[hTCRa-CSDVP]-F-P2A-PAC | 317 | 787 |
| CD8SP-SARScov2-CR3022-vL-[hTCRb-S57C]-F-F2A-SP-SARScov2-CR3022-vH-[hTCRa-T48C] | 318 | 788 |
| CD8SP-SARScov2-CR3022-vL-[hTCRb-S57C]-F-F2A-SP-SARScov2-CR3022-vH-[hTCRa-T48C]-F-F2A-K13-opt | 319 | 789 |
| CD8SP-SARScov2-CR3022-vL-[hTCRa-T48C]-F-F2A-SP-SARScov2-CR3022-vH-[hTCRb-S57C] | 320 | 790 |
| CD8SP-SARScov2-CR3022-vL-[hTCRa-T48C]-F-F2A-SP-SARScov2-CR3022-vH-[hTCRb-S57C]-F-P2A-K13-opt | 321 | 791 |
| CD8SP-V5-[hTCRb-KACIAH]-F-P2A-CD8SP-SARScov2-CR3022-vL-GS-linker-SARScov2-CR3022-vH-Myc-[hTCRa-CSDVP]-F-F2A-PAC | 322 | 792 |
| CD8SP-MYC-[hTCRa-T48C-opt1]-F-F2A-SP-SARScov2-CR3022-vL-GS-linker-SARScov2-CR3022-vH-V5-[hTCRb-S57C-opt1]-F-P2A-PAC | 323 | 793 |
| CD8SP-SARScov2-CR3022-vL-[hTCRb-opt2]-F-P2A-SP-SARScov2-CR3022-vH-[hTCRa-opt2]-F-F2A-PAC | 324 | 794 |
| CD8SP-SARScov2-CR3022-vL-[hTCRb-opt2]-F-P2A-SP-SARScov2-CR3022-vH-Myc-[preTCRa-Del48]-F-F2A-PAC | 325 | 795 |
| CD8SP-[hTCRb-opt2]-F-P2A-CD8SP-SARscov2-CR3022-vL-GS-linker-SARScov2-CR3022-vH-Myc4-[preTCRa-Del48]-F-F2A-PAC | 326 | 796 |
| CD8SP-SARScov2-CR3022-vL-V5-[hTCRg1-opt]-F-P2A-SP-SARScov2-CR3022-vH-Myc-[hTCRd-opt]-F-F2A-PAC | 327 | 797 |
| CD8SP-SARScov2-CR3022-vL-[hTCRd-opt]-F-P2A-SP-SARScov2-CR3022-vH-[hTCRg1-opt] | 328 | 798 |
| CD8SP-V5-[hTCRg1-opt]-F-P2A-CD8SP-SARScov2-CR3022-vL-GS-linker-SARScov2-CR3022-vH-Myc-[hTCRd-opt]-F-F2A-PAC | 329 | 799 |

TABLE 9-continued

Exemplary SABR Targeting SARS-cov2 S-RBD

| Name of fragment | SEQ ID NO (DNA) | SEQ ID NO (PRT) |
|---|---|---|
| CD8SP-SARScov2-CR3022-vL-IgCL-Bam-CD3zECDTMCP-opt-F-P2A-Spe-SP-Bst-SARScov2-CR3022-vH-IgG1-CH1-KPN-CD3zECDTMCP-opt2-F-F2A-Xba-PAC | 330 | 800 |
| CD8SP-SARScov2-CR3022-vL-[hTCRbECD-Bam-CD3zECDTMCP-opt]-F-P2A-SP-SARScov2-CR3022-vH-[hTCRaECD-Kpn-CD3zECDTMCP-opt2] | 331 | 801 |
| CD8SP-SARScov2-CR3022-vL-[hTCRb-KAC-ECD-Bam-CD3zECDTMCP-opt]-F-P2A-SP-SARScov2-CR3022-vH-[hTCRa-CSDVP-ECD-Kpn-CD3zECDTMCP-opt2] | 332 | 802 |
| CD8SP-SARScov2-CR3022-vL-V5-[hTCRbECD-Bam-CD3zECDTMCP-opt]-F-P2A-SP-SARScov2-CR3022-vH-Myc-[hTCRaECD-Kpn-CD3zECDTM-28z-opt2] | 333 | 803 |
| CD8SP-SARScov2-CR3022-vL-V5-[hTCRbECD-Bam-CD3zECDTM-28z-opt]-F-P2A-SP-SARScov2-CR3022-vH-Myc-[hTCRaECD-Kpn-CD3zECDTM-28z-opt2] | 334 | 804 |
| CD8SP-SARScov2-CR3022-vL-V5-[hTCRbECD-Bam-CD3zECDTMCP-opt]-F-P2A-SP-SARScov2-CR3022-vH-Myc4-[hTCRaECD-Kpn-CD3zECDTM-BBz-opt2] | 335 | 805 |
| CD8SP-SARScov2-CR3022-vL-V5-[hTCRbECD-Bam-CD3zECDTM-BBz-opt]-F-P2A-SP-SARScov2-CR3022-vH-Myc4-[hTCRaECD-Kpn-CD3zECDTM-BBz-opt2] | 336 | 806 |
| CD8SP-SARScov2-CR3022-vL-CD3zECDTMCP-opt-F-P2A-Spe-SP-Bst-SARSv2-CR3022-vH-Mlu-CD3zECDTMCP-opt2-F-F2A-PAC | 337 | 807 |
| CD8SP-SARScov2-CR3022-vL-[IgCL-TCRg-6MD]-F-P2A-SP-SARScov2-CR3022-vH-[IgG1-CH1-TCRd-6MD] | 338 | 808 |
| CD8SP-SARScov2-CR3022-vL-[IgCL-TCRb-IAH-6MD]-F-P2A-SP-SARScov2-CR3022-vH-[IgG1-CH1-TCRa-SDVP-6MD] | 339 | 809 |
| CD8SP-SARScov2-CR3022-vL-[IgCL-TCRb-wt-opt2-6MD]-F-P2A-SP-SARScov2-CR3022-vH-[IgG1-CH1-TCRa-wt-op2-6MD] | 340 | 810 |
| CD8SP-SARScov2-CR3022-(vL-vH)-CD3e-ECDTMCP-opt2 | 341 | 811 |
| CD8SP-SARScov2-CR3022-(vL-vH)-CD3d-ECDTMCP-opt2 | 342 | 812 |
| CD8SP-SARScov2-CR3022-(vL-vH)-CD3g-ECDTMCP-opt2 | 343 | 813 |
| CD8SP-SARScov2-CR3022-(vL-vH)-CD3z-ECDTMCP-opt2 | 344 | 814 |
| CD8SP-SARScov2-CR3022-(vH-vL)-CD3e-ECDTMCP-opt2 | 345 | 815 |
| CD8SP-SARScov2-CR3022-(vH-vL)-CD3d-ECDTMCP-opt2 | 346 | 816 |
| CD8SP-SARScov2-CR3022-(vH-vL)-CD3g-ECDTMCP-opt2 | 347 | 817 |
| CD8SP-SARScov2-CR3022-(vH-vL)-CD3z-ECDTMCP-opt2 | 348 | 818 |
| CD8SP-SARScov2-CR3022-vL-GS-linker-SARScov2-CR3022-vH-[hTCRa-opt2]-F-F2A-PAC | 349 | 819 |
| CD8SP-SARScov2-CR3022-vL-GS-linker-SARScov2-CR3022-vH-[hTCRP-opt2]-F-F2A-PAC | 350 | 820 |
| CD8SP-SARScov2-CR3022-vL-GS-linker-SARScov2-CR3022-vH-Myc4-[preTCRa-Del48]-F-F2A-PAC | 351 | 821 |
| CD8SP-SARScov2-CR3022-vL-[hTCRb-opt2]-F-P2A-PAC | 352 | 822 |
| CD8SP-SARScov2-CR3022-vL-[hTCRb-opt2] | 353 | 823 |
| IgHSP-SARScov2-CR3022-vH-[hTCRa-opt2]-F-F2A-BlastR | 354 | 824 |
| IgHSP-SARScov2-CR3022-vH-[hTCRa-opt2] | 355 | 825 |
| CD8SP-SARScov2-CR3022-vL-V5-[hTCRP-S57C-opt]-F-P2A-PAC | 356 | 826 |
| CD8SP-SARScov2-CR3022-vL-V5-[hTCRP-S57C-opt] | 357 | 827 |
| IgHSP-SARScov2-CR3022-vH-Myc-[hTCRa-T48C-opt]-F-F2A-BlastR | 358 | 828 |
| IgHSP-SARScov2-CR3022-vH-Myc-[hTCRa-T48C-opt] | 359 | 829 |
| CD8SP-SARScov2-CR3022-vL-GS-linker-SARScov2-CR3022-vH-[hTCRa-SDVP]-F-F2A-PAC | 360 | 830 |
| CD8SP-SARScov2-CR3022-vL-GS-linker-SARScov2-CR3022-vH-[hTCRP-KAIAH]-F-P2A-PAC | 361 | 831 |
| CD8SP-SARScov2-CR3022-(vL-vH)-G4S-CD3e-ECDTMCP-opt2-F-F2A-PAC | 362 | 832 |
| CD8SP-SARScov2-CR3022-(vL-vH)-G4S-CD3d-ECDTMCP-opt2-F-F2A-PAC | 363 | 833 |
| CD8SP-SARScov2-CR3022-(vL-vH)-G4S-CD3g-ECDTMCP-opt2-F-F2A-PAC | 364 | 834 |
| CD8SP-SARScov2-CR3022-(vL-vH)-G4S-CD3z-ECDTMCP-opt2-F-F2A-PAC | 365 | 835 |

TABLE 10

Exemplary SABR Targeting SARS-cov2 S-RBD

| Name of fragment | SEQ ID NO (DNA) | SEQ ID NO (PRT) |
|---|---|---|
| CD8SP-SARScov2-S-RBD-H4-vL-GS-linker-SARScov2-S-RBD-H4-vH-Myc-CD8TM-BBz-T2A-PAC | 367 | 837 |
| CD8SP-SARScov2-S-RBD-H4-vL-GS-linker-SARScov2-S-RBD-H4-vH-Myc-28z-T2A-PAC | 368 | 838 |
| CD8SP-SARScov2-S-RBD-H4-vL-GS-linker-SARScov2-S-RBD-H4-vH-Myc-28z | 369 | 839 |
| CD8SP-SARScov2-S-RBD-H4-vL-GS-linker-SARScov2-S-RBD-H4-vH-Myc-CD8TM-BBz | 370 | 840 |
| CD8SP-SARScov2-S-RBD-H4-vH-GS-linker-vL-Myc-CD8TM-BBz | 371 | 841 |
| CD8SP-SARScov2-S-RBD-H4-vL-GS-linker-SARScov2-S-RBD-H4-vH-Myc-CD8TM-z-P2A-K13-FLAG-T2A-PAC | 372 | 842 |
| CD8SP-SARScov2-S-RBD-H4-vL-[hTCRa-CSDVP]-F-F2A-SP-SARScov2-S-RBD-H4-vH-[hTCRb-KACIAH]-F-P2A-PAC | 373 | 843 |
| CD8SP-SARScov2-S-RBD-H4-vL-[hTCRb-KACIAH]-F-P2A-SP-SARScov2-S-RBD-H4-vH-[hTCRa-CSDVP]-F-F2A-PAC | 374 | 844 |
| CD8SP-SARScov2-S-RBD-H4-vL-[hTCRb-S57C]-F-P2A-SP-SARScov2-S-RBD-H4-vH-[hTCRa-T48C] | 375 | 845 |
| CD8SP-SARScov2-S-RBD-H4-vL-[hTCRb-S57C]-F-P2A-SP-SARScov2-S-RBD-H4-vH-[hTCRa-T48C]-F-F2A-K13-opt | 376 | 846 |
| CD8SP-SARScov2-S-RBD-H4-vL-[hTCRa-T48C]-F-P2A-SP-SARScov2-S-RBD-H4-vH-[hTCRb-S57C] | 377 | 847 |
| CD8SP-SARScov2-S-RBD-H4-vL-[hTCRa-T48C]-F-P2A-SP-SARScov2-S-RBD-H4-vH-[hTCRb-S57C]-F-F2A-K13-opt | 378 | 848 |
| CD8SP-V5-[hTCRb-KACIAH]-F-P2A-CD8SP-SARScov2-S-RBD-H4-vL-GS-linker-SARScov2-S-RBD-H4-vH-Myc-[hTCRa-CSDVP]-F-F2A-PAC | 379 | 849 |
| CD8SP-MYC-[hTCRa-T48C-opt1]-F-F2A-SP-SARScov2-S-RBD-H4-vL-GS-linker-SARScov2-S-RBD-H4-vH-V5-[hTCRb-S57C-opt1]-F-P2A-PAC | 380 | 850 |
| CD8SP-SARScov2-S-RBD-H4-vL-[hTCRb-opt2]-F-P2A-SP-SARScov2-S-RBD-H4-vH-[hTCRa-opt2]-F-F2A-PAC | 381 | 851 |
| CD8SP-SARScov2-S-RBD-H4-vL-[hTCRb-opt2]-F-P2A-SP-SARScov2-S-RBD-H4-vH-Myc-[preTCRa-Del48]-F-F2A-PAC | 382 | 852 |
| CD8SP-[hTCRb-opt2]-F-P2A-CD8SP-SARScov2-S-RBD-H4-vL-GS-linker-SARScov2-S-RBD-H4-vH-Myc4-[preTCRa-Del48]-F-F2A-PAC | 383 | 853 |
| CD8SP-SARScov2-S-RBD-H4-vL-V5-[hTCRg1-opt]-F-P2A-SP-SARScov2-S-RBD-H4-vH-Myc-[hTCRd-opt]-F-F2A-PAC | 384 | 854 |
| CD8SP-SARScov2-S-RBD-H4-vL-[hTCRd-opt]-F-P2A-SP-SARScov2-S-RBD-H4-vH-[hTCRg1-opt] | 385 | 855 |
| CD8SP-V5-[hTCRg1-opt]-F-P2A-CD8SP-SARScov2-S-RBD-H4-vL-GS-linker-SARScov2-S-RBD-H4-vH-Myc-[hTCRd-opt]-F-F2A-PAC | 386 | 856 |
| CD8SP-SARScov2-S-RBD-H4-vL-IgCL-Bam-CD3zECDTMCP-opt-F-P2A-Spe-SP-Bst-SARScov2-S-RBD-H4-vH-IgG1-CH1-KPN-CD3zECDTMCP-opt2-F-F2A-Xba-PAC | 387 | 857 |
| CD8SP-SARScov2-S-RBD-H4-vL-[hTCRbECD-Bam-CD3zECDTMCP-opt]-F-P2A-SP-SARScov2-S-RBD-H4-vH-[hTCRaECD-Kpn-CD3zECDTMCP-opt2] | 388 | 858 |
| CD8SP-SARScov2-S-RBD-H4-vL-[hTCRb-KAC-ECD-Bam-CD3zECDTMCP-opt]-F-P2A-SP-SARScov2-S-RBD-H4-vH-[hTCRa-CSDVP-ECD-Kpn-CD3zECDTMCP-opt2] | 389 | 859 |
| CD8SP-SARScov2-S-RBD-H4-vL-V5-[hTCRbECD-Bam-CD3zECDTMCP-opt]-F-P2A-SP-SARScov2-S-RBD-H4-vH-Myc-[hTCRaECD-Kpn-CD3zECDTM-28z-opt2] | 390 | 860 |
| CD8SP-SARScov2-S-RBD-H4-vL-V5-[hTCRbECD-Bam-CD3zECDTM-28z-opt]-F-P2A-SP-SARScov2-S-RBD-H4-vH-Myc-[hTCRaECD-Kpn-CD3zECDTM-28z-opt2] | 391 | 861 |
| CD8SP-SARScov2-S-RBD-H4-vL-V5-[hTCRbECD-Bam-CD3zECDTMCP-opt]-F-P2A-SP-SARScov2-S-RBD-H4-vH-Myc4-[hTCRaECD-Kpn-CD3zECDTM-BBz-opt2] | 392 | 862 |
| CD8SP-SARScov2-S-RBD-H4-vL-V5-[hTCRbECD-Bam-CD3zECDTM-BBz-opt]-F-P2A-SP-SARScov2-S-RBD-H4-vH-Myc4-[hTCRaECD-Kpn-CD3zECDTM-BBz-opt2] | 393 | 863 |
| CD8SP-SARScov2-S-RBD-H4-vL-CD3zECDTMCP-opt-F-P2A-Spe-SP-Bst-SARScov2-S-RBD-H4-vH-Mlu-CD3zECDTMCP-opt2-F-F2A-PAC | 394 | 864 |
| CD8SP-SARScov2-S-RBD-H4-vL-[IgCL-TCRg-6MD]-F-P2A-SP-SARScov2-S-RBD-H4-vH-[IgG1-CH1-TCRd-6MD] | 395 | 865 |
| CD8SP-SARScov2-S-RBD-H4-vL-[IgCL-TCRb-IAH-6MD]-F-P2A-SP-SARScov2-S-RBD-H4-vH-[IgG1-CH1-TCRa-SDVP-6MD] | 396 | 866 |
| CD8SP-SARScov2-S-RBD-H4-vL-[IgCL-TCRb-wt-opt2-6MD]-F-P2A-SP-SARScov2-S-RBD-H4-vH-[IgG1-CH1-TCRa-wt-op2-6MD] | 397 | 867 |
| CD8SP-SARScov2-S-RBD-H4-(vL-vH)-CD3e-ECDTMCP-opt2 | 398 | 868 |
| CD8SP-SARScov2-S-RBD-H4-(vL-vH)-CD3d-ECDTMCP-opt2 | 399 | 869 |
| CD8SP-SARScov2-S-RBD-H4-(vL-vH)-CD3g-ECDTMCP-opt2 | 400 | 870 |
| CD8SP-SARScov2-S-RBD-H4-(vL-vH)-CD3z-ECDTMCP-opt2 | 401 | 871 |

TABLE 10-continued

Exemplary SABR Targeting SARS-cov2 S-RBD

| Name of fragment | SEQ ID NO (DNA) | SEQ ID NO (PRT) |
|---|---|---|
| CD8SP-SARScov2-S-RBD-H4-(vH-vL)-CD3e-ECDTMCP-opt2 | 402 | 872 |
| CD8SP-SARScov2-S-RBD-H4-(vH-vL)-CD3d-ECDTMCP-opt2 | 403 | 873 |
| CD8SP-SARScov2-S-RBD-H4-(vH-vL)-CD3g-ECDTMCP-opt2 | 404 | 874 |
| CD8SP-SARScov2-S-RBD-H4-(vH-vL)-CD3z-ECDTMCP-opt2 | 405 | 875 |
| CD8SP-SARScov2-S-RBD-H4-vL-GS-linker-SARScov2-S-RBD-H4-vH-[hTCRa-opt2]-F-F2A-PAC | 406 | 876 |
| CD8SP-SARScov2-S-RBD-H4-vL-GS-linker-SARScov2-S-RBD-H4-vH-[hTCRb-opt2]-F-F2A-PAC | 407 | 877 |
| CD8SP-SARScov2-S-RBD-H4-vL-GS-linker-SARScov2-S-RBD-H4-vH-Myc4-[preTCRa-Del48]-F-F2A-PAC | 408 | 878 |
| CD8SP-SARScov2-S-RBD-H4-vL-[hTCRb-opt2]-F-P2A-PAC | 409 | 879 |
| CD8SP-SARScov2-S-RBD-H4-vL-[hTCRb-opt2] | 410 | 880 |
| IgHSP-SARScov2-S-RBD-H4-vH-[hTCRa-opt2]-F-F2A-BlastR | 411 | 881 |
| IgHSP-SARS-cov2-S-RBD-H4-vH-[hTCRa-opt2] | 412 | 882 |
| CD8SP-SARS-cov2-S-RBD-H4-vL-V5-[hTCRb-S57C-opt]-F-P2A-PAC | 413 | 883 |
| CD8SP-SARS-cov2-S-RBD-H4-vL-V5-[hTCRb-S57C-opt] | 414 | 884 |
| IgHSP-SARS-cov2-S-RBD-H4-vH-Myc-[hTCRa-T48C-opt]-F-F2A-BlastR | 415 | 885 |
| IgHSP-SARS-cov2-S-RBD-H4-vH-Myc-[hTCRa-T48C-opt] | 416 | 886 |
| CD8SP-SARS-cov2-S-RBD-H4-vL-Gly-Ser-Linker-SARS-cov2-S-RBD-H4-vH-[hTCRa-SDVP]-F-F2A-PAC | 417 | 887 |
| CD8SP-SARS-cov2-S-RBD-H4-vL-Gly-Ser-Linker-SARS-cov2-S-RBD-H4-vH-[hTCRb-KAIAH]-F-P2A-PAC | 418 | 888 |
| CD8SP-SARS-cov2-S-RBD-H4-(vL-vH)-G4S-CD3e-ECDTMCP-opt2-F-F2A-PAC | 419 | 889 |
| CD8SP-SARS-cov2-S-RBD-H4-(vL-vH)-G4S-CD3d-ECDTMCP-opt2-F-F2A-PAC | 420 | 890 |
| CD8SP-SARS-cov2-S-RBD-H4-(vL-vH)-G4S-CD3g-ECDTMCP-opt2-F-F2A-PAC | 421 | 891 |
| CD8SP-SARS-cov2-S-RBD-H4-(vL-vH)-G4S-CD3z-ECDTMCP-opt2-F-F2A-PAC | 422 | 892 |

TABLE 11

Exemplary SABR Targeting SARS-cov2 S-RBD

| Name of fragment | SEQ ID NO (DNA) | SEQ ID NO (PRT) |
|---|---|---|
| CD8SP-SARScov2-S-RBD-B38-vL-GS-linker-SARScov2-S-RBD-B38-vH-Myc-CD8TM-BBz-T2A-PAC | 424 | 894 |
| CD8SP-SARScov2-S-RBD-B38-vL-GS-linker-SARScov2-S-RBD-B38-vH-Myc-28z-T2A-PAC | 425 | 895 |
| CD8SP-SARScov2-S-RBD-B38-vL-GS-linker-SARScov2-S-RBD-B38-vH-Myc-28z | 426 | 896 |
| CD8SP-SARScov2-S-RBD-B38-vL-GS-linker-SARScov2-S-RBD-B38-vH-Myc-CD8TM-BBz | 427 | 897 |
| CD8SP-SARScov2-S-RBD-B38-vH-GS-linker-vL-Myc-CD8TM-BBz | 428 | 898 |
| CD8SP-SARScov2-S-RBD-B38-vL-GS-linker-SARScov2-S-RBD-B38-vH-Myc-CD8TM-z-P2A-K13-FLAG-T2A-PAC | 429 | 899 |
| CD8SP-SARScov2-S-RBD-B38-vL-[hTCRa-CSDVP]-F-F2A-SP-SARScov2-S-RBD-B38-vH-[hTCRb-KACIAH]-F-P2A-PAC | 430 | 900 |
| CD8SP-SARScov2-S-RBD-B38-vL-[hTCRb-KACIAH]-F-P2A-SP-SARScov2-S-RBD-B38-vH-[hTCRa-CSDVP]-F-F2A-PAC | 431 | 901 |
| CD8SP-SARScov2-S-RBD-B38-vL-[hTCRb-S57C]-F-P2A-SP-SARScov2-S-RBD-B38-vH-[hTCRa-T48C] | 432 | 902 |
| CD8SP-SARScov2-S-RBD-B38-vL-[hTCRb-S57C]-F-P2A-SP-SARScov2-S-RBD-B38-vH-[hTCRa-T48C]-F-F2A-K13-opt | 433 | 903 |
| CD8SP-SARScov2-S-RBD-B38-vL-[hTCRa-T48C]-F-P2A-SP-SARScov2-S-RBD-B38-vH-[hTCRb-S57C] | 434 | 904 |
| CD8SP-SARScov2-S-RBD-B38-vL-[hTCRa-T48C]-F-P2A-SP-SARScov2-S-RBD-B38-vH-[hTCRb-S57C]-F-P2A-K13-opt | 435 | 905 |
| CD8SP-V5-[hTCRb-KACIAH]-F-P2A-CD8SP-SARScov2-S-RBD-B38-vL-GS-linker-SARScov2-S-RBD-B38-vH-Myc-[hTCRa-CSDVP]-F-F2A-PAC | 436 | 906 |
| CD8SP-MYC-[hTCRa-T48C-opt1]-F-F2A-SP-SARScov2-S-RBD-B38-vL-GS-linker-SARScov2-S-RBD-B38-vH-V5-[hTCRb-S57C-opt1]-F-P2A-PAC | 437 | 907 |
| CD8SP-SARScov2-S-RBD-B38-vL-[hTCRb-opt2]-F-P2A-SP-SARScov2-S-RBD-B38-vH-[hTCRa-opt2]-F-F2A-PAC | 438 | 908 |
| CD8SP-SARScov2-S-RBD-B38-vL-[hTCRb-opt2]-F-P2A-SP-SARScov2-S-RBD-B38-vH-Myc-[preTCRa-Del48]-F-F2A-PAC | 439 | 909 |

TABLE 11-continued

Exemplary SABR Targeting SARS-cov2 S-RBD

| Name of fragment | SEQ ID NO (DNA) | SEQ ID NO (PRT) |
|---|---|---|
| CD8SP-[hTCRb-opt2]-F-P2A-CD8SP-SARScov2-S-RBD-B38-vL-GS-linker-SARScov2-S-RBD-B38-vH-Myc4-[preTCRa-Del48]-F-F2A-PAC | 440 | 910 |
| CD8SP-SARScov2-S-RBD-B38-vL-V5-[hTCRg1-opt]-F-P2A-SP-SARScov2-S-RBD-B38-vH-Myc-[hTCRd-opt]-F-F2A-PAC | 441 | 911 |
| CD8SP-SARScov2-S-RBD-B38-vL-[hTCRd-opt]-F-P2A-SP-SARScov2-S-RBD-B38-vH-[hTCRg1-opt] | 442 | 912 |
| CD8SP-V5-[hTCRg1-opt]-F-P2A-CD8SP-SARScov2-S-RBD-B38-vL-GS-linker-SARScov2-S-RBD-B38-vH-Myc-[hTCRd-opt]-F-F2A-PAC | 443 | 913 |
| CD8SP-SARScov2-S-RBD-B38-vL-IgCL-Bam-CD3zECDTMCP-opt-F-P2A-Spe-SP-Bst-SARScov2-S-RBD-B38-vH-IgG1-CH1-KPN-CD3zECDTMCP-opt2-F-F2A-Xba-PAC | 444 | 914 |
| CD8SP-SARScov2-S-RBD-B38-vL-[hTCRbECD-Bam-CD3zECDTMCP-opt]-F-P2A-SP-SARScov2-S-RBD-B38-vH-[hTCRaECD-Kpn-CD3zECDTMCP-opt2] | 445 | 915 |
| CD8SP-SARScov2-S-RBD-B38-vL-[hTCRb-KAC-ECD-Bam-CD3zECDTMCP-opt]-F-P2A-SP-SARScov2-S-RBD-B38-vH-[hTCRa-CSDVP-ECD-Kpn-CD3zECDTMCP-opt2] | 446 | 916 |
| CD8SP-SARScov2-S-RBD-B38-vL-V5-[hTCRbECD-Bam-CD3zECDTMCP-opt]-F-P2A-SP-SARScov2-S-RBD-B38-vH-Myc-zECDTM-28z-opt2] | 447 | 917 |
| CD8SP-SARScov2-S-RBD-B38-vL-V5-[hTCRbECD-Bam-CD3zECDTM-28z-opt]-F-P2A-SP-SARScov2-S-RBD-B38-vH-Myc-[hTCRaECD-Kpn-CD3zECDTM-28z-opt2] | 448 | 918 |
| CD8SP-SARScov2-S-RBD-B38-vL-V5-[hTCRbECD-Bam-CD3zECDTMCP-opt]-F-P2A-SP-SARScov2-S-RBD-B38-vH-Myc4-[hTCRaECD-Kpn-CD3zECDTM-BBz-opt2] | 449 | 919 |
| CD8SP-SARScov2-S-RBD-B38-vL-V5-[hTCRbECD-Bam-CD3zECDTM-BBz-opt]-F-P2A-SP-SARScov2-S-RBD-B38-vH-Myc4-[hTCRaECD-Kpn-CD3zECDTM-BBz-opt2] | 450 | 920 |
| CD8SP-SARScov2-S-RBD-B38-vL-CD3zECDTMCP-opt-F-P2A-Spe-SP-Bst-SARScov2-S-RBD-B38-vH-Mlu-CD3zECDTMCP-opt2-F-F2A-PAC | 451 | 921 |
| CD8SP-SARScov2-S-RBD-B38-vL-[IgCL-TCRg-6MD]-F-P2A-SP-SARScov2-S-RBD-B38-vH-[IgG1-CH1-TCRd-6MD] | 452 | 922 |
| CD8SP-SARScov2-S-RBD-B38-vL-[IgCL-TCRb-IAH-6MD]-F-P2A-SP-SARScov2-S-RBD-B38-vH-[IgG1-CH1-TCRa-SDVP-6MD] | 453 | 923 |
| CD8SP-SARScov2-S-RBD-B38-vL-[IgCL-TCRb-wt-opt2-6MD]-F-P2A-SP-SARScov2-S-RBD-B38-vH-[IgG1-CH1-TCRa-wt-op2-6MD] | 454 | 924 |
| CD8SP-SARScov2-S-RBD-B38-(vL-vH)-CD3e-ECDTMCP-opt2 | 455 | 925 |
| CD8SP-SARScov2-S-RBD-B38-(vL-vH)-CD3d-ECDTMCP-opt2 | 456 | 926 |
| CD8SP-SARScov2-S-RBD-B38-(vL-vH)-CD3g-ECDTMCP-opt2 | 457 | 927 |
| CD8SP-SARScov2-S-RBD-B38-(vL-vH)-CD3z-ECDTMCP-opt2 | 458 | 928 |
| CD8SP-SARScov2-S-RBD-B38-(vH-vL)-CD3e-ECDTMCP-opt2 | 459 | 929 |
| CD8SP-SARScov2-S-RBD-B38-(vH-vL)-CD3d-ECDTMCP-opt2 | 460 | 930 |
| CD8SP-SARScov2-S-RBD-B38-(vH-vL)-CD3g-ECDTMCP-opt2 | 461 | 931 |
| CD8SP-SARScov2-S-RBD-B38-(vH-vL)-CD3z-ECDTMCP-opt2 | 462 | 932 |
| CD8SP-SARScov2-S-RBD-B38-vL-GS-linker-SARScov2-S-RBD-B38-vH-[hTCRa-opt2]-F-F2A-PAC | 463 | 933 |
| CD8SP-SARScov2-S-RBD-B38-vL-GS-linker-SARScov2-S-RBD-B38-vH-[hTCRb-opt2]-F-F2A-PAC | 464 | 934 |
| CD8SP-SARScov2-S-RBD-B38-vL-GS-linker-SARScov2-S-RBD-B38-vH-Myc4-[preTCRa-Del48]-F-F2A-PAC | 465 | 935 |
| CD8SP-SARScov2-S-RBD-B38-vL-[hTCRb-opt2]-F-P2A-PAC | 466 | 936 |
| CD8SP-SARScov2-S-RBD-B38-vL-[hTCRb-opt2] | 467 | 937 |
| IgHSP-SARScov2-S-RBD-B38-vH-[hTCRa-opt2]-F-F2A-BlastR | 468 | 938 |
| IgHSP-SARS-cov2-S-RBD-B38-vH-[hTCRa-opt2] | 469 | 939 |
| CD8SP-SARS-cov2-S-RBD-B38-vL-V5-[hTCRb-S57C-opt]-F-P2A-PAC | 470 | 940 |
| CD8SP-SARS-cov2-S-RBD-B38-vL-V5-[hTCRb-S57C-opt] | 471 | 941 |
| IgHSP-SARS-cov2-S-RBD-B38-vH-Myc-[hTCRa-T48C-opt]-F-F2A-BlastR | 472 | 942 |
| IgHSP-SARS-cov2-S-RBD-B38-vH-Myc-[hTCRa-T48C-opt] | 473 | 943 |
| CD8SP-SARS-cov2-S-RBD-B38-vL-Gly-Ser-Linker-SARS-cov2-S-RBD-B38-vH-[hTCRa-SDVP]-F-P2A-PAC | 474 | 944 |
| CD8SP-SARS-cov2-S-RBD-B38-vL-Gly-Ser-Linker-SARS-cov2-S-RBD-B38-vH-[hTCRb-KAIAH]-F-P2A-PAC | 475 | 945 |
| CD8SP-SARS-cov2-S-RBD-B38-(vL-vH)-G4S-CD3e-ECDTMCP-opt2-F-F2A-PAC | 476 | 946 |
| CD8SP-SARS-cov2-S-RBD-B38-(vL-vH)-G4S-CD3d-ECDTMCP-opt2-F-F2A-PAC | 477 | 947 |
| CD8SP-SARS-cov2-S-RBD-B38-(vL-vH)-G4S-CD3g-ECDTMCP-opt2-F-F2A-PAC | 478 | 948 |
| CD8SP-SARS-cov2-S-RBD-B38-(vL-vH)-G4S-CD3z-ECDTMCP-opt2-F-F2A-PAC | 479 | 949 |

TABLE 12

| Name of fragment | SEQ ID NO (DNA) | SEQ ID NO (PRT) |
|---|---|---|
| Therapeutic Controls | | |
| F2A | 481 | 951 |
| T2A | 482 | 952 |
| P2A | 483 | 953 |
| E2A | 484 | 954 |
| SGSG | 485 | 955 |
| FURINE-CLEAVAGE-SITE | 486 | 956 |
| FURINE-CLEAVAGE-SITE | 487 | 957 |
| FURINE-CLEAVAGE-SITE | 488 | 958 |
| Miscellaneous | | |
| FKBP12-F36V | 1041 | 1161 |
| IKZF1-ZF2-145-167 | 1042 | 1162 |
| IKZF1-ZF2-ZF3-145-197 | 1043 | 1163 |
| IKZF1-ZF2-ZF3-145-243 | 1044 | 1164 |
| IKZFl-ZF2H1ZF2H2ZF2H3-ZF2H2x3 | 1045 | 1165 |
| SARS-cov2-S-Prt-F-P2A-Membrane-gp-F-F2A-Nucleocapsid-F-E2A-orf3 | 1047 | 1167 |
| CD8SP-StreptagII-R1-S-Protein-RBD-Mlu-mCD8-hinge-TM-F-P2A-Membrane-gp-F-F2A-Nucleocapsid | 1048 | 1168 |
| SARS-cov2-S-Prt-F-P2A-Membrane-gp-F-F2A-Nucleocapsid | 1049 | 1169 |
| SARScov2-HLA-A0201-PEPTIDES-F-P2A-Membrane-gp-F-F2A-Nucleocapsid | 1050 | 1170 |
| Ub-G76A-SARScov2-HLA-A0201-Polyepitopes-F-P2A-Membrane-gp-F-F2A-Nucleocapsid | 1051 | 1171 |
| SARScov2-HLA-DRB10401-Polyepitopes-F-P2A-Membrane-gp-F-F2A-Nucleocapsid | 1052 | 1172 |
| Ub-G76A-SARScov2-HLA-DRB10401-Polyepitopes-F-P2A-Membrane-gp-F-F2A-Nucleocapsid | 1053 | 1173 |
| SARS-cov2-Spike-Glycoprotein-1-RBD-(S1-RBD)-FKBP12-F36V | 1054 | 1174 |
| SARS-cov2-Spike-Glycoprotein-1-RBD-(S1-RBD)-IKZF1-ZF2-ZF3-145-243 | 1055 | 1175 |
| SARS-cov2-Spike-Glycoprotein-FKBP12-F36V | 1056 | 1176 |
| SARS-cov2-Spike-Glycoprotein-IKZF1-ZF2-ZF3-145-243 | 1057 | 1177 |
| SARS-cov2-nucleocapsid-FKBP12-F36V | 1058 | 1178 |
| SARS-cov2-nucleocapsid-IKZF1-ZF2-ZF3-145-243 | 1059 | 1179 |
| SARS-cov2-membrane-Glycoprotein-FKBP12-F36V | 1060 | 1180 |
| SARS-cov2-membrane-Glycoprotein-IKZF1-ZF2-ZF3-145-243 | 1061 | 1181 |
| CD8SP-StreptagII-R1-S-Protein-RBD-Mlu-mCD8-hinge-TM-F-P2A-Membrane-gp-F-F2A-Nucleocapsid-FKBP12-F36V | 1062 | 1182 |
| CD8SP-StreptagII-R1-S-Protein-RBD-Mlu-mCD8-hinge-TM-F-P2A-Membrane-gp-F-F2A-Nucleocapsid-IKZF1-ZF2-145-167 | 1063 | 1183 |
| CD8SP-StreptagII-R1-S-Protein-RBD-Mlu-mCD8-hinge-TM-F-P2A-Membrane-gp-F-F2A-Nucleocapsid-IKZF1-ZF2-ZF3-145-197 | 1064 | 1184 |
| CD8SP-StreptagII-R1-S-Protein-RBD-Mlu-mCD8-hinge-TM-F-P2A-Membrane-gp-F-F2A-Nucleocapsid-IKZF1-ZF2-ZF3-145-243 | 1065 | 1185 |
| SARS-cov2-S-Prt-F-P2A-Membrane-gp-F-F2A-Nucleocapsid-FKBP12-F36V | 1066 | 1186 |
| SARScov2-HLA-A0201-PEPTIDES-F-P2A-Membrane-gp-F-F2A-Nucleocapsid-FKBP12-F36V | 1067 | 1187 |
| Ub-G76A-SARScov2-HLA-A0201-Polyepitopes-F-P2A-Membrane-gp-F-F2A-Nucleocapsid-FKBP12-F36V | 1068 | 1188 |
| SARScov2-HLA-DRB10401-Polyepitopes-F-P2A-Membrane-gp-F-F2A-Nucleocapsid-FKBP12-F36V | 1069 | 1189 |
| Ub-G76A-SARScov2-HLA-DRB10401-Polyepitopes-F-P2A-Membrane-gp-F-F2A-Nucleocapsid-FKBP12-F36V | 1070 | 1190 |
| SARS-cov2-S-Prt-F-P2A-Membrane-gp-F-F2A-Nucleocapsid-IKZF1-ZF2-ZF3-145-243 | 1071 | 1191 |
| SARScov2-HLA-A0201-PEPTIDES-F-P2A-Membrane-gp-F-F2A-Nucleocapsid-IKZF1-ZF2-ZF3-145-243 | 1072 | 1192 |
| Ub-G76A-SARScov2-HLA-A0201-Polyepitopes-F-P2A-Membrane-gp-F-F2A-Nucleocapsid-IKZF1-ZF2-ZF3-145-243 | 1073 | 1193 |
| SARScov2-HLA-DRB10401-Polyepitopes-F-P2A-Membrane-gp-F-F2A-Nucleocapsid-IKZF1-ZF2-ZF3-145-243 | 1074 | 1194 |
| Ub-G76A-SARScov2-HLA-DRB10401-Polyepitopes-F-P2A-Membrane-gp-F-F2A-Nucleocapsid-IKZF1-ZF2-ZF3-145-243 | 1075 | 1195 |
| | 1076 | 1196 |
| SARS-cov2-Spike-Glycoprotein-S2-GGSG-NLuc-4xFLAG-x2STREP-8xHis-T2A-PAC | 1077 | 1197 |
| SARS-cov2-Spike-Glycoprotein-S1-ND1-GGSG-NLuc-4xFLAG-x2STREP-8xHis-T2A-PAC | 1078 | 1198 |
| SARS-cov2-Spike-Glycoprotein-S1-ND2-GGSG-NLuc-4xFLAG-x2STREP-8xHis-T2A-PAC | 1079 | 1199 |
| CD8SP-StreptagII-R1-S-Protein-RBD-Mlu-mCD8-hinge-TM | 1080 | 1200 |
| CD8SP-hu-mROO5-1-(vL-vH)-GGSG-NLuc-4xFLAG-x2STREP-8xHis-T2A-PAC | 1081 | 1201 |

TABLE 12-continued

| Name of fragment | SEQ ID NO (DNA) | SEQ ID NO (PRT) |
|---|---|---|
| CD8SP-SARScov2-CR3022-(vL-vH)-GGSG-NLuc-4xFLAG-x2STREP-8xHis-T2A-PAC | 1082 | 1202 |
| CD8SP-SARS-cov2-S-RBD-H4-(vL-vH)-GGSG-NLuc-4xFLAG-x2STREP-8xHis-T2A-PAC | 1083 | 1203 |
| CD8SP-SARScov2-S-RBD-B38-(vL-vH)-GGSG-NLuc-4xFLAG-x2STREP-8xHis-T2A-PAC | 1084 | 1204 |
| CD19-ECD-GGSG-NLuc-4xFlag-2xStreptag-8xHis-T2A-Pac | 1085 | 1205 |
| CD33-ECD-GGSG-NLuc-4xFlag-2xStreptag-8xHis-T2A-Pac | 1086 | 1206 |
| CD8SP-BCMA-ECD-GGSG-NLuc-4xFlag-2xStreptag-8xHis-T2A-Pac | 1087 | 1207 |
| CD8SP-StreptagII-R1-S1-Protein-RBD-ECD-GGSG-NLuc-4xFlag-2xStreptag-8xHis-T2A-Pac | 1088 | 1208 |
| CD8SP-R1-S1-Protein-RBD-ECD-GGSG-NLuc-4xFlag-2xStreptag-8xHis-T2A-Pac | 1089 | 1209 |
| S1-Protein-ECD-GGSG-NLuc-4xFlag-2xStreptag-8xHis | 1090 | 1210 |
| SARS-cov2-nucleocapsid-GGS-NLuc-4xFlag-2xStreptag-8xHis-T2A-PAC | 1091 | 1211 |
| orf3a-GGSG-NLuc-4xFlag-2xStreptag-8xHis | 1092 | 1212 |
| ACE2-ECD-GGS-NLuc-4xFlag-2xStreptag-8xHis | 1093 | 1213 |
| SARS-cov2-Spike-Glycoprotein-S2-GGSG-Gluc-4xFLAG-x2STREP-8xHis-T2A-PAC | 1095 | 1215 |
| SARS-cov2-Spike-Glycoprotein-S1-ND1-GGSG-Gluc-4xFLAG-x2STREP-8xHis-T2A-PAC | 1096 | 1216 |
| SARS-cov2-Spike-Glycoprotein-S1-ND2-GGSG-Gluc-4xFLAG-x2STREP-8xHis-T2A-PAC | 1097 | 1217 |
| CD8SP-hu-mROO5-1-(vL-vH)-GGSG-Gluc-4xFLAG-x2STREP-8xHis-T2A-PAC | 1098 | 1218 |
| CD8SP-SARScov2-CR3022-(vL-vH)-GGSG-Gluc-4xFLAG-x2STREP-8xHis-T2A-PAC | 1099 | 1219 |
| CD8SP-SARS-cov2-S-RBD-H4-(vL-vH)-GGSG-Gluc-4xFLAG-x2STREP-8xHis-T2A-PAC | 1100 | 1220 |
| CD8SP-SARScov2-S-RBD-B38-(vL-vH)-GGSG-Gluc-4xFLAG-x2STREP-8xHis-T2A-PAC | 1101 | 1221 |
| CD19-ECD-GGSG-Gluc-4xFlag-2xStreptag-8xHis-T2A-Pac | 1102 | 1222 |
| CD33-ECD-GGSG-Gluc-4xFlag-2xStreptag-8xHis-T2A-Pac | 1103 | 1223 |
| CD8SP-BCMA-ECD-GGSG-Gluc-4xFlag-2xStreptag-8xHis-T2A-Pac | 1104 | 1224 |
| CD8SP-StreptagII-R1-S1-Protein-RBD-ECD-GGSG-Gluc-4xFlag-2xStreptag-8xHis-T2A-Pac | 1105 | 1225 |
| CD8SP-R1-S1-Protein-RBD-ECD-GGSG-Gluc-4xFlag-2xStreptag-8xHis-T2A-Pac | 1106 | 1226 |
| S1-Protein-ECD-GGSG-Gluc-4xFlag-2xStreptag-8xHis | 1107 | 1227 |
| SARS-cov2-nucleocapsid-GGS-Gluc-4xFlag-2xStreptag-8xHis-T2A-PAC | 1108 | 1228 |
| orf3a-GGSG-Gluc-4xFlag-2xStreptag-8xHis | 1109 | 1229 |
| ACE2-ECD-GGS-Gluc-4xFlag-2xStreptag-8xHis | 1110 | 1230 |
| SARS-cov2-Spike-Glycoprotein-S2-GGSG-TLuc-4xFLAG-x2STREP-8xHis-T2A-PAC | 1112 | 1232 |
| SARS-cov2-Spike-Glycoprotein-S1-ND1-GGSG-TLuc-4xFLAG-x2STREP-8xHis-T2A-PAC | 1113 | 1233 |
| SARS-cov2-Spike-Glycoprotein-S1-ND2-GGSG-TLuc-4xFLAG-x2STREP-8xHis-T2A-PAC | 1114 | 1234 |
| CD8SP-hu-mROO5-1-(vL-vH)-GGSG-TLuc-4xFLAG-x2STREP-8xHis-T2A-PAC | 1115 | 1235 |
| CD8SP-SARScov2-CR3022-(vL-vH)-GGSG-TLuc-4xFLAG-x2STREP-8xHis-T2A-PAC | 1116 | 1236 |
| CD8SP-SARS-cov2-S-RBD-H4-(vL-vH)-GGSG-TLuc-4xFLAG-x2STREP-8xHis-T2A-PAC | 1117 | 1237 |
| CD8SP-SARScov2-S-RBD-B38-(vL-vH)-GGSG-TLuc-4xFLAG-x2STREP-8xHis-T2A-PAC | 1118 | 1238 |
| CD19-ECD-GGSG-TLuc-4xFlag-2xStreptag-8xHis-T2A-Pac | 1119 | 1239 |
| CD33-ECD-GGSG-TLuc-4xFlag-2xStreptag-8xHis-T2A-Pac | 1120 | 1240 |
| CD8SP-BCMA-ECD-GGSG-TLuc-4xFlag-2xStreptag-8xHis-T2A-Pac | 1121 | 1241 |
| CD8SP-StreptagII-R1-S1-Protein-RBD-ECD-GGSG-TLuc-4xFlag-2xStreptag-8xHis-T2A-Pac | 1122 | 1242 |
| CD8SP-R1-S1-Protein-RBD-ECD-GGSG-TLuc-4xFlag-2xStreptag-8xHis-T2A-Pac | 1123 | 1243 |
| S1-Protein-ECD-GGSG-TLuc-4xFlag-2xStreptag-8xHis | 1124 | 1244 |
| SARS-cov2-nucleocapsid-GGS-TLuc-4xFlag-2xStreptag-8xHis-T2A-PAC | 1125 | 1245 |
| orf3a-GGSG-TLuc-4xFlag-2xStreptag-8xHis | 1126 | 1246 |
| ACE2-ECD-GGS-TLuc-4xFlag-2xStreptag-8xHis | 1127 | 1247 |
| SARS-cov2-Spike-Glycoprotein-S2-GGSG-MLuc7-M43L-M110L-4xFLAG-x2STREP-8xHis-T2A-PAC | 1129 | 1249 |
| SARS-cov2-Spike-Glycoprotein-S1-ND1-GGSG-MLuc7-M43L-M110L-4xFLAG-x2STREP-8xHis-T2A-PAC | 1130 | 1250 |
| SARS-cov2-Spike-Glycoprotein-S1-ND2-GGSG-MLuc7-M43L-M110L-4xFLAG-x2STREP-8xHis-T2A-PAC | 1131 | 1251 |
| CD8SP-hu-mROO5-1-(vL-vH)-GGSG-MLuc7-M43L-M110L-4xFLAG-x2STREP-8xHis-T2A-PAC | 1132 | 1252 |

TABLE 12-continued

| Name of fragment | SEQ ID NO (DNA) | SEQ ID NO (PRT) |
|---|---|---|
| CD8SP-SARScov2-CR3022-(vL-vH)-GGSG-MLuc7-M43L-M110L-4xFLAG-x2STREP-8xHis-T2A-PAC | 1133 | 1253 |
| CD8SP-SARS-cov2-S-RBD-H4-(vL-vH)-GGSG-MLuc7-M43L-M110L-4xFLAG-x2STREP-8xHis-T2A-PAC | 1134 | 1254 |
| CD8SP-SARScov2-S-RBD-B38-(vL-vH)-GGSG-MLuc7-M43L-M110L-4xFLAG-x2STREP-8xHis-T2A-PAC | 1135 | 1255 |
| CD19-ECD-GGSG-MLuc7-M43L-M110L-4xFlag-2xStreptag-8xHis-T2A-Pac | 1136 | 1256 |
| CD33-ECD-GGSG-MLuc7-M43L-M110L-4xFlag-2xStreptag-8xHis-T2A-Pac | 1137 | 1257 |
| CD8SP-BCMA-ECD-GGSG-MLuc7-M43L-M110L-4xFlag-2xStreptag-8xHis-T2A-Pac | 1138 | 1258 |
| CD8SP-StreptagII-R1-S1-Protein-RBD-ECD-GGSG-MLuc7-M43L-M110L-4xFlag-2xStreptag-8xHis-T2A-Pac | 1139 | 1259 |
| CD8SP-R1-S1-Protein-RBD-ECD-GGSG-MLuc7-M43L-M110L-4xFlag-2xStreptag-8xHis-T2A-Pac | 1140 | 1260 |
| S1-Protein-ECD-GGSG-MLuc7-M43L-M110L-4xFlag-2xStreptag-8xHis | 1141 | 1261 |
| SARS-cov2-nucleocapsid-GGS-MLuc7-M43L-M110L-4xFlag-2xStreptag-8xHis-T2A-PAC | 1142 | 1262 |
| orf3a-GGSG-MLuc7-M43L-M110L-4xFlag-2xStreptag-8xHis | 1143 | 1263 |
| ACE2-ECD-GGS-MLuc7-M43L-M110L-4xFlag-2xStreptag-8xHis | 1144 | 1264 |

As used herein, the term "biological equivalent thereof" or "variant" or "functional variant" is intended to be synonymous with "equivalent thereof" when referring to a reference protein, antibody or fragment thereof, polypeptide or nucleic acid, intends those having minimal homology while still maintaining desired structure or functionality.

As used herein, the term "CDR" or "complementarity determining region" is intended to mean the non-contiguous antigen combining sites found within the variable region of both heavy and light chain polypeptides. The SEQ IDs of the CDRs of the different vL and vH segments that can be used in the construction of antigen binding domains of SABR targeting the receptor binding domain of the spike glycoprotein of SARS-cov2 of the current disclosure are provided in Table 7A.

The SEQ IDs of the CDRs of the different vL and vH segments that can be used in the construction of antigen binding domains of SABR targeting different antigens (e.g., CD19, CD20, CD22, Mesothelin etc.) of the current disclosure are provided in SEQ ID NO: 13204-14121 and SEQ ID NO: 14122-15039, respectively (Tables 6A, B) of PCT/US18/53247 and in Tables 5-6 in PCT/US2017/064379, which are incorporated herein by reference.

"Chimeric antigen receptors" (CARs) are artificial (non-naturally occurring) immune cell (e.g., T cell) receptors contemplated for use as a therapy for cancer, using a technique called adoptive cell transfer.

The term "SABR" or "Synthetic Antigen Binding Receptor", "Synthetic Antigen Receptor (SAR)" or "Antigen binding Receptor" or "ABR" as described herein refers to any receptor that has an antigen binding domain and is capable of transmitting a signal to an immune cell (e.g., T cell, NK cell, macrophage etc.) when expressed in the said immune cell. SABR when expressed in an effector cell, provides the cell with specificity for a target cell (e.g., a virally infected cell or a cancer cell) that express the antigen bound by the SABR. The antigen binding domain of a SABR may comprise of a scFv, a vL, vH, antibody, antibody fragment (e.g., Fab), antibody like moiety, Vα, Vβ, cytokine, receptor etc. in one embodiment, a SABR has at least one antigen binding domain and at least one transmembrane or membrane anchoring domain that allows it to be expressed on the cell surface. The term "Synthetic Antigen Binding Receptor (SABR)", as used herein, comprises CARs and also encompasses newer approaches to conferring antigen specificity onto cells, such as Antibody-TCR chimeric molecules or Ab-TCR (WO 2017/070608 A1 incorporated herein by reference), TCR receptor fusion proteins or TFP (WO 2016/187349 A1 incorporated herein by reference), Synthetic Immune Receptors (SIRs) (see, WO 2018/102795 A1, incorporated herein by reference), Tri-functional T cell antigen coupler (Tri-TAC or TAC) (see, WO 2015/117229 A1, incorporated herein by reference) and zSIR (see, PCT/US2019/035096, incorporated herein by reference). The nucleic acid sequences of several exemplary TFPs comprising the different antigen binding domains (e.g., vL and vH fragments, vHH, ligands and receptors etc.) and based on CD3ε, CD3δ, CD3γ and CD3ζ chains and co-expressing the optional accessory module NEMO-K277A are presented in SEQ ID NO:1900-2205, 2206-2511, 2512-2817, 2818-3123, respectively (Table 13) of PCT/US18/53247, which is incorporated in its entirety by reference herein. The order of the antigen binding domains contained in the construct of different CAR architectures and BiTE listed in Table 13 of PCT/US18/53247, which is incorporated in its entirety by reference herein is the same as the order of the constructs on the zCAR-K277A architecture presented in Table 12 of PCT/US18/53247, which is incorporated in its entirety by reference herein. Typically, the term "SABR-T cell" is used, to refer to T-cells that have been engineered to express a Synthetic antigen binding receptor. Thus, T lymphocytes bearing such SABRs are generally referred to as SABR-T lymphocytes. If the SABR is a CAR, then the T cells are referred to as CAR-T cells. SABRs can be also expressed in cells other than T cells, such as hematopoietic stem cells, induced pluripotent stem cells (iPSC), NK cells and macrophage.

The term "binding" or "interacting" refers to an association, which may be a stable association, between two molecules, e.g., between a TCR and a peptide/MHC, due to, for example, electrostatic, hydrophobic, ionic and/or hydrogen-bond interactions under physiological conditions.

The term "single chain variable fragment" or "scFv" refers to an Fv fragment in which the heavy chain domain and the light chain domain are linked.

The term "Fv fragment" refers to the fragment of an antibody comprising the variable domains of its heavy chain and light chain.

The term "specifically bind", "specific binding", or "targeting", as used herein, when referring to a polypeptide (including antibodies) or receptor, refers to a binding reaction which is determinative of the presence of the protein or polypeptide or receptor in a heterogeneous population of proteins and other biologicals.

The term "epitope" means a protein determinant capable of specific binding to an antibody or TCR.

The term "expression vector" refers to a vector comprising a recombinant polynucleotide comprising expression control sequences operatively linked to a nucleotide sequence to be expressed.

"Immune cell" as used herein refers to the cells of the mammalian immune system including but not limited to antigen presenting cells, B-cells, basophils, cytotoxic T-cells, dendritic cells, eosinophils, granulocytes, helper T-cells, leukocytes, lymphocytes, macrophages, mast cells, memory cells, monocytes, natural killer cells, neutrophils, phagocytes, plasma cells and T-cells.

"Immune effector cell," as that term is used herein, refers to a cell that is involved in an immune response, e.g., in the promotion of an immune effector response.

"Immune effector function" or "immune effector response," "effector function" refers to the specialized function of a differentiated immune cell.

"Native" or "Naturally occurring" or "endogenous" as used herein refers to a gene, protein, nucleic acid (e.g., DNA, RNA etc.) or fragment thereof that is native to a cell or is naturally expressed in a cell.

As used herein a "non-naturally occurring agent" or "non-native" or "exogenous" refers to an agent that is not naturally expressed in a cell. Stated another way, the non-naturally occurring agent is "engineered" to be expressed in a cell. As used herein a "non-naturally occurring immune receptor" or "exogenous immune receptor" refers to an immune receptor that is not naturally expressed in an immune cell. Stated another way, the non-naturally occurring immune receptor is "engineered" to be expressed in an immune cell.

The term "Synthetic Immune Receptor" or alternatively a "SIR" refers to next generation CAR platforms that are described in WO 2018/102795 A1 which is incorporated herein by reference.

As used herein, the phrase "pharmaceutically-acceptable carrier" means a pharmaceutically-acceptable material, composition or vehicle, such as a liquid or solid filler, diluent, excipient, or solvent encapsulating material, involved in carrying or transporting an agent from one organ, or portion of the body, to another organ, or portion of the body.

As used herein, "specific binding" refers to the ability of a SAM to bind to a protein or to a peptide presented on an MHC (e.g. class I MEC or class II MEC). T In certain embodiments, agents of the invention may be used alone or conjointly administered with another type of therapeutic agent.

The terms "T-cell" and "T-lymphocyte" are interchangeable and used synonymously herein. Examples include but are not limited to naïve T cells ("lymphocyte progenitors"), central memory T cells, effector memory T cells, stem memory T cells (Tscm), iPSC-derived T cells, synthetic T cells or combinations thereof.

The term "TCR receptor fusion proteins" or "TFP" refers to a next generation SAR platform as described in WO 2016/187349 A1 which is incorporated herein by reference.

"SARS-cov2" or "novel coronavirus" or "severe acute respiratory syndrome coronavirus 2" as described herein is the etiological agent of coronavirus disease 2019 (COVID-19) or a variant thereof.

"SARS-cov2 immune" or "SARS-cov2 positive" as the term used herein refers to subjects or donors who have evidence of cellular and/or humoral immunity to SARS-cov2. In an embodiment, the SARS-cov2 immune subjects are subjects who have a history of infection with SARS-cov2. In an embodiment, the SARS-cov2 immune subjects are subjects who have a history of having received a SARS-cov2 vaccine. In an embodiment, the SARS-cov2 immune subjects have T cells that recognize one or more antigens encoded by SARS-cov2. In an embodiment, the SARS-cov2 immune subjects have antibodies against one or more antigens encoded by SARS-cov2. Exemplary antigens encoded by SARS-cov2 include Spike glycoprotein, nucleocapsid protein and membrane glycoprotein.

"SARS-Cov2 specific T cells" or "SARS-Cov2 reactive T cells" as described herein refer to T cells that bind to one or more SARS-Cov2 peptides when presented by the MHC complex. SARS-Cov2 specific T cells can be recognized by methods known in the art, such as staining with MHC tetramers.

Matador Assay as the term used herein refers to a non-radioactive luciferase-based cytotoxicity assay as described in PCT/US2017/024843 and Matta H, et al. (2018) Scientific reports 8(1):199, which are incorporated in their entirety by reference herein.

Topanga Assay as the term used herein refers to a non-radioactive luciferase based assay for detection of an antigen binding domain or an SABR incorporating an antigen binding domain as described in Gopalakrishnan R, et al. (2019) Scientific reports 9(1):1957, which is incorporated in their entirety by reference herein.

Malibu-Glo assay as the term used herein refers to a non-radioactive luciferase based assay for detection of an antigen as described in Natarajan V, et al. (2020) Scientific reports 10(1):2318, which is incorporated in their entirety by reference herein.

Generation and Expansion of Viral Specific (e.g., SARS-Cov2 Specific) T Cells for Adoptive Cellular Therapy In one aspect, the studies disclosed herein seek to determine the impact of various SABR-T cell stimuli amenable to a high-yield manufacturing process, and/or for enriching memory T cell immunophenotypes in a final therapeutic product. Standard anti-CD3/CD28 bead-based stimulation is widely used in the field as a method to expand T cells ex vivo or in vitro prior to transduction with SABR-encoding vectors. However, disclosed herein are manufacturing processes for SARS-Cov2 antigen-stimulated T cells (e.g., SARS-CoV2-specific T cells) that also express one or more SABRs. Such processes may comprise an initial T-cell enrichment step, wherein $CD3^+$ T cells are enriched/purified from a more heterogeneous mixture of cells (e.g., from whole blood, from PBMCs, and the like); stimulated to recognize and respond to pre-selected antigens (e.g., viral antigens or other tumor/disease-associated antigens, etc.); and transduced with one or more SABR constructs. For example, a sample of cells obtained from a SARS-Cov2 subject comprising $CD3^+$ T cells (e.g., PBMC) may be enriched for $CD3^+$ T cells, and said $CD3^+$ T cells brought into contact with antigen-presenting stimulator cells.

In an embodiment, the SARS-Cov2 specific T cells are directly used to manufacture SABR-T cells. In an embodiment, the SARS-Cov2 specific T cells are used to generate iPSC cells. In an embodiment, the iPSC (induced pluripotent stem cells) generated from SARS-Cov2 specific T cells are used to express SABR and then differentiated into SARS-Cov2 specific T cells expressing the SABR. Methods to generate iPSC from T cells and methods to generate T cells from iPSC are known in the art.

In an embodiment, the $CD3^+$ T cells are isolated from the sample and then expanded by making contact with the SARS-Cov2 antigen-presenting stimulator cells. More preferably, the T cells and SARS-Cov2 antigen-presenting stimulator cells (e.g., BLCLs, T cells) are derived from the same sample and are thus HLA-matched. Such cell selection methods and techniques generally include positive selection of $CD3^+$ and/or $CD19^+$ cells from the sample and/or negative selection by depletion of undesired cells or components from the sample. For example, and without limitation, such methods comprise selection with live cell sorting techniques (e g, fluorescence activated cell sorting), anti-CD3 and/or anti-CD19 beads (e.g., magnetic beads), plastic adherence, depletion of B cells, elutriation, and/or combinations thereof. A portion of the resultant $CD3^+$ T cells may be transduced with a viral vector encoding a synthetic antigen binding receptor or SABR (e.g. a CAR, SIR, Ab-TCR, cTCR, TFP etc.) before and/or after contact with antigen-presenting stimulator cells. In an exemplary embodiment, SABR targeting CD19 are presented in SEQ ID NO: 253-308 (Table 8). In an embodiment, the remaining $CD3^+$ T cell population may be transduced with a vector encoding one or more proteins or peptides encoded by a virus (e.g., SARS-cov2) and expanded to generate antigen-presenting stimulator cells. In an exemplary embodiment, SARS-cov2 encoded proteins that can be used for generation of stimulator cells are provided in nucleic acid SEQ ID NO:231-234 and amino acid SEQ ID NO:701-704 (Table 7). SARS-cov2 encoded polypeptides and polyepitopes that can be used for generation of stimulator cells are provided in nucleic acid SEQ ID NO:225-229 and amino acid SEQ ID NO:695-699 (Table 7). In an embodiment, B cells or BLCLs may be transduced with a vector encoding one or more proteins (SEQ NO:701-704) or polypeptides (SEQ ID NO:225-229) encoded by a virus (e.g., SARS-cov2) and expanded to generate antigen-presenting stimulator cells.

Until now, methods for the manufacture of SABR-T cells known in the art have relied on either a crude and heterogeneous starting material, such as PBMC (see Sun et al. Journal for ImmunoTherapy of Cancer (2015) 3:5) or highly purified isolates of specific T cell types, i.e., $CD4^+$, $CD8^+$ T cells, or specific ratios thereof (see Terakura et al. Blood (2011) 119: 1 and Turtle et al. Sci Transl Med. (2016) September 7; 8). However, the invention disclosed herein provides ex vivo methods for enriching SARS-cov2 antigen-specific T cells to be used in the manufacture of SABR-T cells and for use as cellular vaccine. Notably, in some preferred embodiments, such methods comprise obtaining a sample of cells (e.g., PBMC) from a SARS-cov2-immune subject comprising $CD3^+$ cells and contacting said $CD3^+$ cells with SARS-cov2 antigen-presenting stimulator cells. In an embodiment, the $CD3^+$ T cells are isolated from the sample prior to contacting the SARS-cov2 antigen-presenting stimulator cells by methods known in the art (e.g., positive selection of $CD3^+$ cells from the sample and/or negative selection by depletion of undesired cells or components from the sample). For example, and without limitation, such methods include selection using fluorescence activated cell sorting (FACS), with anti-CD3 beads (e.g., magnetic beads), plastic adherence, depletion of NK cells using anti-CD56, elutriation, and/or combinations thereof. Sensitizing the selected $CD3^+$ cells to SARS-cov2 viral antigen, may promote a central memory phenotype in the resultant SARS-cov2 antigen-specific T cell population. Such cells may be transduced with a viral vector encoding a synthetic antigen binding receptor (SABR) before and/or after contact with the SARS-cov2 antigen-presenting stimulator cells. In an exemplary embodiment, T cells are transduced with one or more SABRs targeting CD19, which are presented in SEQ ID NO: 253-308 (Table 8). Exemplary SABR targeting other antigens are known in the art and described in WO 2017/070608 A1, WO 2016/187349 A1, WO 2018/102795 A1, WO 2015/117229 A1, PCT/US2019/035096, which are all incorporated herein by reference. In some such embodiments the SABR-expressing SARS-cov2 antigen-specific $CD3^+$ T cells are cultured with the SARS-cov2 antigen-presenting stimulator cells.

The initial $CD3^+$ enrichment step disclosed herein provides a starting material that is significantly less heterogeneous than a PBMC sample yet retains some level of heterogeneity over highly purified cell fractions. Without wishing to be bound by theory, it is postulated that by using an initial $CD3^+$ enrichment step, the starting material comprises a mixture of cells (including at least a plurality of effector T cell types, T helper cells ($CD4^+$ T cells/TH cells), cytotoxic T cells ($cD8^+$ T cells/CTLs), memory T cell types (i.e., central memory T cells (TCM cells), effector memory T cells (TEM cells), tissue resident memory T cells (TRI), and virtual memory T cells (TVM cells)), regulatory T cells (Treg cells), natural killer T cells (NKT cells), mucosal associated invariant cells (MAIT cells), gamma delta T cells (gd T cells), double-negative T cells (DNTs), $CD3^+$ B cells, or any combination thereof) which may work synergistically or provide an advantageous milieu to promote increased viability and proliferation of SARS-cov2-antigen-specific T cells following contact with SARS-cov2-presenting APCs, improved transduction efficiency of SABR-expressing vector in such SARS-cov2 antigen-specific T cells, and a higher percentage of TCM cells in the final therapeutic composition.

In some embodiments, further enrichment is conducted following T cell stimulation with a SARS-cov2 antigen. For example, NK depletion (e.g., CD56 depletion) may be employed prior to a subsequent antigen stimulation step (i.e. prior to re-stimulation of enriched, SARS-cov2 antigen-specific, T cells with one or more SARS-cov2 antigens)

Stimulation and Transduction

Manufacture of T cells expressing an SABR (e.g., a CAR, SIR, Ab-TCR, or recombinant TCR) that specifically binds to a protein or a peptide presented on a class I MHC requires T cell expansion against defined antigens. In some embodiments, the T cells express a SABR (e.g., a CAR, SIR, Ab-TCR, TFP, recombinant TCR etc.) that specifically binds to a disease-associated peptide (e.g., a tumor-associate peptide, antigen, ligand, or the like) or protein antigen (e.g., CD19, CD20, CD22, BCMA, Mesothelin, PSMA etc.).

SARS-cov2 antigen delivery may be via viral infection by native virus, or via transduction using recombinant virus, of a sample of peripheral blood mononuclear cells (PBMCs) from healthy donors, isolated B cell lymphoblastoid cells (e.g., $CD19^+$ BLEU) therefrom or isolated T cells (e.g., $CD3^+$ T cells) therefrom. In an embodiment, SARS-cov2 antigen delivery may be via viral infection by native virus, or via transduction using recombinant virus, of an antigen presenting cell line. Exemplary antigen presenting cell lines include, but are not limited to, K562, REC-1, MINO, JEKO-1, and GRANTA-519. In an embodiment, in addition to presenting SARS-cov2 specific antigens, the APC (e.g., K562, REC-1, MINO, JEKO-1, and GRANTA-519 cells) are engineered to express one or more co-stimulatory molecules (e.g., 4-1BBL, CD32, CD80, CD83 and CD86) or cytokines (IL2, IL15 and IL21 etc.).

Thus, the infected or transduced cells act as antigen-presenting cells and are referred to as "stimulators". In certain embodiments, the stimulator cells also express a peptide (i.e., antigen) or protein on the cell surface that is recognized by the SABR. The stimulator cells may endogenously express such SABR-targeted peptides (e.g., peptides derived from CD1.9, CD20, CD22, NY-ESO-1, WT1, Myc, AFP etc.) or proteins (e.g., CD19, CD20, CD22, BCMA, Mesothelin, PSMA etc.), or protein fragments (e.g. tCD19, tBCMA etc.) or be engineered to express such peptides/proteins. The SEQ ID of tEGFRviii, tCD19 and tBCMA are provided in SEQ ID NO: 194-196 (Table 6). The stimulator cells may also co-express a protein that selectively activates the NF-κB pathway. The nucleic acid and amino acid sequence of vFLIP K13, an exemplary protein that selectively activates NF-κB pathway, are provided in SEQ ID NO: 199 and 669, respectively. Other exemplary proteins known to selectively activate the NF-κB pathway include NEMO-K277A and constitutive active mutants of IKKα, IKKβ, NIK and MYD88. The viral vector used to transduce stimulators may be a recombinant, replication incompetent virus (e.g., an adenovirus or a lentiviral vector such as pLENTI-EF1α; SEQ ID NO: 1). Alternatively, said stimulator cells are infected with a wild type/native virus.

A separate sample or culture (e.g., PBMCs from the same donor that are not used for transduction, a sample of PBMCs from a different donor, or CD3$^+$ cells isolated therefrom) comprises "responders" and contains T cells that become the active component of a therapy, expressing a T cell receptor that specifically binds to a peptide or protein antigen presented by stimulator cells.

In an embodiment, SARS-Cov2 specific T cells are obtained from an SARS-CoV2 immune subject. In an embodiment, SARS-Cov2 specific T cells are obtained from a SARS-CoV2 immune subject who has received a SARS-Cov2 specific vaccine. In an embodiment, SARS-Cov2 specific T cells are obtained from a SARS-CoV2 immune subject who has received a booster dose of a SARS-Cov2 specific vaccine. In an embodiment, the SARS-Cov2 specific T cells are obtained from a subject 1 day, 2 days, 3 days, 4 days, 5 days, 6 days, 7 days, 8 days, 9 days, 10 days, 11 days, 12 days, 13 days, 14 days, 15 days, 16 days, 17 days, 18 days, 19 days, 20 days, 21 days, 22 days, 23 days, 24 days, 25 days, 26 days, 27 days, 28 days, 29 days, 30 days, 1 month, 2 months, 3 months, 4 months, 5 months, 6 months, 7 months, 8 months, 9 months, 10 months, 11 months, 12 months or 2 years after receiving a primary and/or booster dose of a SARS-Cov2 specific vaccine. In an exemplary embodiment, the SARS-CoV2 vaccine is a vaccine that is manufactured by Moderna, Pfizer, Astrazaneca or Johnson and Johnson. The SARS-Cov2 specific T cells can be isolate by any of the methods known in the art.

In an embodiment, the donor from whom the responder T cells are collected is a SARS-cov2 immune donor who has recovered from a SARS-cov2 infection and/or shows evidence of cellular and/or humoral immunity to SARS-cov2. A number of test to determine cellular and humoral immunity to SARS-cov2 are known in the art, including, but not limited to, presence of IgG antibodies or cells specific to one or more proteins (e.g. Spike glycoprotein or nucleocapsid protein) or peptide antigens encoded by SARS-cov2. In an embodiment, the donor from whom the responder T cells are collected is a SARS-cov2 immune donor who has received a SARS-cov2 vaccine and shows evidence of cellular and/or humoral immunity to SARS-cov2. In an embodiment, the donor from whom the responder T cells are collected is a SARS-cov2 immune donor who is administered one or more booster doses of a SARS-cov2 vaccine prior to collection of PBMC and T cells. A number of SARS-cov2 vaccines are being tested and are known in the art. In an embodiment, the donor is given up to 5 or more booster doses (e.g., 2, 3, 4, 5 booster doses etc.) of SARS-cov2 vaccine prior to collection of PBMC and T cells. In an embodiment, the PBMC and T cells are collected from the donor between 1 and 30 days after the last dose of the SARS-cov2 vaccine. In an embodiment, the donor from whom the responder T cells are collected is a SARS-cov2 immune donor who is selected for donation based on the level of SARS-cov2 specific antibodies (e.g., level of IgG antibodies against SARS-cov2) or percentage of SARS-cov2 reactive CD4 and CD8 T cells as determined by methods known in the art (Grifoni et al., 2020, Cell Host & Microbe 27, 671-680). In an embodiment, the donor is selected based on the level of SARS-cov2 specific antibodies that are at least 20% higher than a reference control (i.e., a subject who is not SARS-cov2 immune). In an embodiment, the donor is selected based on the level of SARS-cov2 specific T cells (CD4 or CD8 T cells) that are at least 20% higher than a reference control (i.e., a subject who is not SARS-cov2 immune). In an embodiment, the donor is selected based on the level of SARS-cov2 specific IgG antibodies that are in the top 20, 30, 40, 50, 60, 70, 80, 90 percentile of the SARS-cov2 immune subjects. In an embodiment, the donor is selected if they show level of SARS-cov2 specific T cells (Cat or CD8 T cells) that are at least 20% higher than a reference control (i.e., a subject who is not SARS-cov2 immune). In an embodiment, the donor is selected if they show level of SARS-cov2 specific T cells (CD4 or CD8 T cells) that are in the top 20, 30, 40, 50, 60, 70, 80, 90 percentile of the SARS-cov2 immune subjects.

In another embodiment, the donor from whom the responder T cells are collected is not a SARS-cov2 immune donor.

The responder T cells may be isolated from PBMC by any suitable method, of which many are well known in the art. In an embodiment, the "stimulator" cells (e.g., PBMCs, I cells or BLCLs) are obtained from the same cell population (e.g., PBMC sample) as are the "responder" cells such that they are identically HLA-matched. For example, a PBMC sample from a donor is split into a "stimulator" cell fraction and a "responder" cell fraction, wherein the responder cells may be enriched for CD3$^+$ cells; and stimulator cells are transduced or infected so as to present particular SARS-cov2 antigens on the cell surface. In an alternate embodiment, the PBMC sample from a donor is enriched for CD3$^+$ cells, which are then split into "stimulator" cell fraction and a "responder" cell fraction. The "stimulator" CD3$^+$ cell fraction is transduced or infected so as to present particular SARS-cov2 antigens on the cell surface. Optionally, the stimulator cell fraction may be enriched by methods known in the art prior to transduction/infection, such as by selection for CD19$^+$ cells. Thus, the SARS-cov2 antigen-presenting cells (e.g., PBMCs, CD3$^+$T cells, or BLCLs) will present the SARS-cov2 antigen to responder T cells (e.g., CD3$^+$-enriched cells), thus activating and inducing proliferation of SARS-cov2 antigen-specific T cells. In some such embodiments, the responder T cells (e.g., isolated T cells) are transduced with a SABR-encoding vector prior to presentation of SARS-cov2 antigen by the stimulator fraction (e.g., PBMCs, CD3⁺T cells, or BLCLs). In certain embodiments, the responder T cells (e.g., isolated. T cells) are transduced with a SABR-encoding vector after presentation of SARS-cov2 antigen by the stimulator fraction (e.g., PBMCs, CD3⁺T cells, or BLCLs). In alternate embodiment, cell lines (e.g., aK562, JEMO-1, REC-1 etc.) can be transduced or infected so as to present particular SARS-cov2 antigens on the cell surface and act as "stimulator" or antigen presenting cells.

Accordingly, provided herein are methods of generating allogeneic or autologous T cells that express a T cell receptor that specifically binds to, for example, an SARS-cov2 peptide presented on a class I or II MHC and further express a synthetic antigen binding receptor (SABR) that binds to a selected target (e.g., CD 19). In some embodiments, APCs are generated through viral infection of stimulator cells, e.g., by wild type/native SARS-cov2 or an adenoviral vector that encodes a polyepitope of defined CTL epitopes from SARS-cov2 Spike Glycoprotein, nucleocapside protein, membrane glycoprotein sequence or orf 1 ab. In some embodiments, the stimulator cells are mixed with non-infected, isolated T cells (responders) so as to present the SARS-cov2 polyepitopes to said T cells. In some embodiments, isolated, virus-specific T cells presented with SARS-cov2 polyepitopes are activated and induced for proliferation.

In some embodiments, the responder cells and the stimulator cells are each derived from peripheral blood mononuclear cells (PBMC). In some such embodiments, the responder cells and the stimulator cells are each derived from PBMCs from the same donor. In other embodiments, the responder cells and the stimulator cells are each derived from PBMCs from different donors. In other embodiments, the responder cells derived from PBMCs from a SARS-cov2 immune donor, e.g., a SARS-cov2 positive donor, e.g., a donor with history of infection with SARS-cov2 or a history of immunization with a SARS-cov2 vaccine. In some such embodiments, prior to contact with stimulator cells, responder cells are isolated and/or purified so as to consist essentially of T cells. In preferred embodiments, the responder cells are isolated and/or purified so as to consist essentially of CD3⁺ cells. Most preferably, the responder cells consist essentially of CD3⁺ T cells.

Prior to presentation to responder cells (e.g., T cells), stimulator cells may be infected with a native virus, such as SARS-cov2, thereby presenting viral antigens on their surface. In some embodiments, the stimulator cells are transduced with a viral vector, preferably an adenoviral vector or a lentiviral vector, comprising a nucleic acid sequence encoding a SARS-cov2 antigen. In some such embodiments, the adenoviral vector is replication incompetent. More preferably, the vector comprises a nucleic acid sequence encoding one or more SARS-cov2 antigens. The one or more SARS-cov2 antigens may comprise a Spike Glycoprotein (SEQ II) NO: 231 and SEQ ID NO: 701) or fragment thereof (e.g., S1-RBD), S2 protein (SEQ ID NO: 694) or fragment thereof, a nucleocapsid polypeptide (SEQ ID NO: 232 and SEQ ID NO: 702) or fragment thereof, membrane glycoprotein (SEQ ID NO: 233 and SEQ ID NO: 703) or fragment thereof, orf3 (SEQ ID NO: 234 and 704) or fragment thereof and/or orf 1 ab or fragment thereof. In an embodiment, the SARS-cov2 antigen is the receptor binding domain of the Spike glycoprotein (S1-RBD) (SEQ ID NO: 230 and 700). In an embodiment the S1-RBD is expressed on the cell surface in fusion with a heterologous transmembrane domain or a membrane anchoring domain. The nucleic acid and amino acid sequence of an exemplary S1-RBD fusion protein comprising the S1-RBD in fusion with the hinge and transmembrane domains of mouse CD8 are presented in SEQ ID NO:229 and 699, respectively.

In an embodiment, the one or more SARS-cov2 antigens are expressed in fusion with a protein degradation domain, such as ubiquitin or a ubiquitin mutant. An exemplary ubiquitin mutant is ubiquitin G67A. The protein degradation domain may be fused to the amino or the carboxy terminus of the one or more SARS-cov2 antigens.

In an embodiment, the one or more SARS-cov2 antigen proteins are expressed in fusion with a drug inducible protein degradation domain (DIPDD). Exemplary DIPDD include FKBP12-F36V (SEQ ID NO: 1161), IKZF1-ZF2-145-167 (SEQ ID NO: 1162), IKZF1-ZF2-ZF3-145-197 (SEQ ID NO: 1162) and IKZF1-ZF2-ZF3-145-243 (SEQ ID NO: 1163). The DIPDD can be attached to the N- or the C-terminus of the SARS-cov2 encoded proteins and/or polyepitopes. Exemplary SARS-cov2 proteins and polyepitopes in fusion with the different DIPDD are represented by SEQ ID NO: 1176-1195. The proteins carrying the FKBP12-F36V (SEQ ID NO: 1161) DIPDD are degraded by addition of dTAG13 and its homologs, while proteins carrying IKZF1-ZF2-145-167 (SEQ ID NO: 1162), IKZF1-ZF2-ZF3-145-197 (SEQ ID NO: 1162) and IKZF1-ZF2-ZF3-145-243 (SEQ ID NO: 1163) are degraded by the addition of IMiDs (immune modulatory drugs), such as pomalidomide, lenalidomide, CC220, and CC885. Other DIPDDs are known in the art and can be used in alternate embodiment of the disclosure. In an embodiment, the stimulator cells expressing the SARS-cov2 antigen-DIPDD fusions are treated with dTAG13 or IMIDs in vitro. In an embodiment, the stimulator cells expressing the SARS-cov2 antigen-DIPDD fusions are treated with dTAG13 or IMIDs in vivo. In an embodiment, treatment with dTAG13 or IMIDs is carried out for between 1-30 days. In an embodiment, cell are treated with dTAG13 or its homologs at concentration of between 1 nM to 1 μM. In an embodiment, cell are treated with IMIDs at concentration of between 10 pM to 1 μM.

In an embodiment, the vector encodes poly epitope derived from different antigens of SARS-cov2, such as spike glycoprotein, nucleocapsid and membrane glycoprotein, orf3a and/or orf 1 ab. In an embodiment, the vector encodes a poly epitope of defined CTL epitopes from spike glycoprotein, nucleocapsid and membrane glycoprotein, orf3a and/or orf 1 ab. An exemplary poly epitope derived from SARS-cov2 antigens that are presented by HLA-A0201 is represented by nucleic acid and amino acid SEQ II) NO: 225 and 695, respectively. In an embodiment, the vector encodes a poly epitope of defined cm epitopes from spike glycoprotein, nucleocapsid and membrane glycoprotein and/or orf 1 ab fused to ubiquitin or a mutant thereof. An exemplary ubiquitin mutant is ubiquitin G67A (SEQ ID NO: 212 and SEQ ID NO: 682). The protein degradation domain may be fused to the amino or the carboxy, terminus of the one or more SARS-cov2 antigens or polyepitopes. An exemplary poly epitope derived from SARS-cov2 antigens that is presented by HLA-A0201 and in fusion with a Ub-G67A mutant is represented by nucleic acid and amino acid SEQ ID NO: 226 and 696, respectively. An exemplary poly epitope derived from SARS-cov2 antigens that is presented by HLA-DRB10401 is represented by nucleic acid and amino acid SEQ ID NO: 227 and 697, respectively. An exemplary poly epitope derived from SARS-cov2 antigens that is presented by HLA-DRB10401 and in fusion with a Ub-G67A mutant is represented by nucleic acid and amino acid SEQ ID NO: 228 and 698, respectively. In an embodiment, the vector encodes a poly epitope derived from spike glycoprotein, nucleocapsid and membrane glycoprotein and/or orf 1 ab fused to one or more proteins encoded by SARS-cov2. In an embodiment, the vector encodes a poly epitope of defined CTL epitopes from nucleocapsid and membrane glycoprotein fused to Spike Glycoprotein.

In some embodiments, the stimulator cells are incubated with one or more cytokines prior to culturing with (i.e., presentation to) responder cells (e.g., non-infected PBMC or CD3+ enriched cells). Such stimulator cells may comprise B cells (e.g., BLCLs), antigen-presenting T-cells, dendritic cells, artificial antigen-presenting cells, and/or aK562 cells. In preferred embodiments, the stimulator cells are antigen-presenting BLCLs. In some embodiments, the stimulator cells also express a module that results in NF-κB activation. Exemplary module that results in NF-κB activation is vFLIP K13 (SEQ ID NO: 199 and SEQ ID NO: 669) and hNEMO-K277A.

Though antigen-specific cells achieve activation and proliferation when presented with antigen by the stimulator fraction, such stimulator cells are not desirable in the final harvested SABR-T cell product. Moreover, in order to minimize the risk of any viral recombination events in proliferating cells leading to formation of competent virus, the stimulator cells are treated and/or modified prior to culturing with responder T cells so as to inhibit proliferation, e.g., by irradiation with gamma rays or exposure to an agent such as mitomycin C. For example, in such culture conditions, responder cells (e.g., I-cells) are presented with peptide antigens by non-proliferating stimulator cells. In some such embodiments, the culture is maintained from at least 24 hours to at least 28 days prior to transduction with a SABR-encoding vector. In some embodiments, the culture is maintained for at least 24 hours, at least 2 days, at least 3 days, at least 4 days, at least 0.5 days, at least 6 days, at least 7 days, at least 8 days, at least 9 days, at least 9 days, at least 10 days, at least 11 days, at least 12 days, at least 13 days, at least 14 days, at least 17 days, or at least 28 days prior to transduction with a SABR-encoding vector. Preferably, the culture is maintained for at least 2 days after antigen presentation by stimulator cells prior to transduction with a SABR-encoding vector, Most preferably, the culture is maintained for at least 6 days after antigen presentation by stimulator cells prior to transduction with a SABR-encoding vector. In further embodiments, the culture is maintained from at least 24 hours to at least 28 days following transduction with a SABR-encoding vector. In certain embodiments, the culture is maintained for at least 24 hours, at least 2 days, at least 3 days, at least 4 days, at least 5 days, at least 6 days, at least 7 days, at least 8 days, at least 9 days, at least 9 days, at least 10 days, at least 11 days, at least 12 days, at least 13 days, at least 14 days, at least 17 days, or at least 28 days following transduction with a SABR-encoding vector. In some embodiments, the culture is re-seeded and/or re-stimulated as necessary.

For example, responder T cells undergo at least a first stimulation step (i.e., presented with antigen on APCs) and may be re-seeded and/or re-stimulated as needed (i.e., a second time or more). Said re-seeded and/or re-stimulated culture is maintained for at least 24 hours, at least 3 days, at least 9 days, at least 11 days, at least 14 days, at least 17 days, or at least 28 days prior to/or following transduction with a SABR-encoding vector. In preferred embodiments, a responder cell culture is stimulated at least once prior to transduction with a SABR-encoding vector. More preferably, the responder culture is stimulated multiple times, wherein subsequent stimulation steps are separated by anywhere from 2 to 14 days. For example, a culture undergoing a first stimulation may undergo a second stimulation (e.g., re-stimulation) 11 days after the first stimulation; optionally, a third stimulation (e.g., re-stimulation) is initiated 7 days after the second stimulation step. A culture undergoing a stimulation step (e.g., re-stimulation) is maintained for at least 1 to 10 days before transduction with a SABR-encoding vector. Preferably, the culture is maintained for at least 2 days before transduction with a SABR-encoding vector. Most preferably, the culture is maintained for at least 6 days after antigen presentation by stimulator cells prior to transduction with a SABR-encoding vector. Optionally, an NK depletion step is employed prior to stimulation. For Example, CD56+ cells may be depleted from culture (e.g. with anti-CD56 beads) immediately prior to stimulation by APCs.

In certain embodiments, after at least a first presentation of antigen to achieve activation and proliferation, the SARS-cov2 antigen-specific T-cells may be frozen and stored prior to and/or following transduction with a SABR-encoding vector, to be thawed at a future date. In some embodiments, said thawed culture is re-stimulated and/or re seeded as necessary, and said re-stimulated and/or re-seeded culture is maintained for at least 24 hours, at least 2 days, at least 3 days, at least 9 days, at least 11 days, at least 14 days, at least 17 days, or at least 28 days prior to/or following transduction with a SABR-encoding vector as described herein. Likewise, in such cases wherein the culture is re stimulated multiple times, subsequent stimulation steps are separated by anywhere from 2 to 14 days, as described herein.

The activation and proliferation of antigen-specific T cells also requires a sufficient amount of antigen-presentation by stimulator cells. Accordingly, the stimulation cultures contemplated herein (e.g., including re-stimulation cultures) comprise known ratios of responder cells to simulator cells. For example, the ratio of responder cells to simulator cells is about 0.1:1 to about 20:1. For example, and without limitation, in preferred embodiments, the initial stimulation comprises a responder: stimulator ratio of about 0.43:1. A subsequent stimulation (e.g., re stimulation) may comprise a responder: stimulator ratio of 0.25:1 and a yet further stimulation (e.g., re-stimulation) comprises a responder: stimulator ratio of 4:1.

In certain aspects, provided herein are methods of generating allogeneic or autologous SABR-T cells expressing TCRs that specifically bind to peptides (e.g., antigens) comprising T cell epitopes presented on MHC (e.g. class I MHC), and SABRs that bind to a selected target, such as a disease-associated peptide target, for treating autoimmune disorders and cancers (e.g., MS, SAD, IBD, and/or CD19+ B-cell malignancies, lymphomas, leukemias, and/or solid tumors). Contemplated herein are T cells suitable for the production of SABR-T cells generated by incubating a sample comprising T cells (e.g., a PBMC sample or CD3+ cells isolated therefrom) with antigen-presenting cells (APCs) that present one or more of the T cell epitopes described herein (e.g., APCs that present a peptide described herein comprising a SARS-cov2 epitope on a MHC complex, such as SARS-cov2-infected or recombinantly transduced BLCLs, T cells or aK562).

In some embodiments, the peptides comprising a T cell epitope, as described herein, comprise epitope from SARS-cov2. In some embodiments, the epitopes are HLA class restricted T cell epitopes. In other embodiments, the epitopes are HLA class H-restricted.

The peptides provided herein may comprise a sequence of any SARS-cov2 viral protein (e.g., a sequence of at least 5, 6, 7, 8, 9, 10, 11, 12, 13, 14, 15, 16, 17, 18, 19 or 20 contiguous amino acids of any SARS-cov2 protein). In some embodiments, the peptides provided herein comprise no more than 25, 20, 19, 18, 17, 16, 15, 14, 13, 12, 11 or 10 contiguous amino acids of the SARS-cov2 viral protein.

The peptides provided herein may comprise a sequence of Spike Glycoprotein (e.g., a sequence of at least 5, 6, 7, 8, 9, 10, 11, 12, 13, 14, 15, 16, 17, 18, 19 or 20 contiguous amino acids of Spike Glycoprotein). In some embodiments, the peptides provided herein comprise no more than 25, 20, 19, 18, 17, 16, 15, 14, 13, 12, 11 or 10 contiguous amino acids of Spike Glycoprotein. Several variants of Spike glycoprotein have been isolated and are covered in alternate embodiment of the disclosure. An exemplary Spike Glycoprotein amino acid sequence is provided in SEQ ID NO: 701.

In some embodiments, the peptides provided herein comprise a sequence of SARS-cov2 nucleocapsid phosphoprotein (e.g., a sequence of at least 5, 6, 7, 8, 9, 10, 11, 12, 14, 15, 16, 17, 18, 19 or 20 contiguous amino acids). In some embodiments, the peptides provided herein comprise no more than 25, 20, 19, 18, 17, 16, 15, 14, 13, 12, 11 or 10 contiguous amino acids of SARS-cov2 nucleocapsid phosphoprotein. An exemplary SARS-cov2 nucleocapsid phosphoprotein amino acid sequence is provided in SEQ ID NO: 702.

In some embodiments, the peptides provided herein comprise a sequence of SARS-cov2 membrane glycoprotein (e.g., a sequence of at least 5, 6, 7, 8, 9, 10, 11, 12, 13, 14, 15, 16, 17, 18, 19 or 20 contiguous amino acids of SARS-cov2 membrane glycoprotein). In some embodiments, the peptides provided herein comprise no more than 25, 20, 19, 18, 17, 16, 15, 14, 13, 12, 11 or 10 contiguous amino acids of SARS-cov2 membrane glycoprotein. An exemplary SARS-cov2 membrane glycoprotein amino acid sequence is provided in SEQ ID NO: 703.

Preferably, the peptide comprises the sequence of an epitope listed in Table 13,

TABLE 13

MHC RESTRICTED SARS-cov2 PEPTIDEs

| NAME | SEQ ID NO | SEQUENCE | MHC restriction |
|---|---|---|---|
| SARS-cov2-S-Prt-Pep1 | 980 | KLPDDFTGCV | HLA-A*0201 |
| SARS-cov2-S-Prt-Pep2 | 981 | ILPDPSKPS | HLA-A*0201 |
| SARS-cov2-S-Prt-Pep3 | 982 | VLNDILSRL | HLA-A*0201 |
| SARS-cov2-S-Prt-Pep4 | 983 | VVFLHVTYV | HLA-A2 |
| SARS-cov2-S-Prt-Pep5 | 984 | LITGRLQSL | HLA-A2 |
| SARS-cov2-S-Prt-Pep6 | 985 | FIAGLIAIV | HLA-A2 |
| SARS-cov2-S-Prt-Pep7 | 986 | RLNEVAKNL | HLA-A*0201 |
| SARS-cov2-S-Prt-Pep8 | 987 | NLNESLIDL | HLA-A*0201 |
| SARS-cov2-S-Prt-Pep9 | 988 | ALNTLVKQL | HLA-A*0201 |
| SARS-cov2-S-Prt-Pep10 | 989 | SIIAYTMSL | HLA-A*0201 |
| SARS-cov2-S-Prt-Pep11 | 990 | IRGWIFGTTLDSKTQSLL | DRB1*04:01 |
| SARS-cov2-S-Prt-Pep12 | 991 | CTFEYVSQPFLMD | DRB1*04:01 |
| SARS-cov2-S-Prt-Pep13 | 992 | QPFLMDLEGKQGN | DRB1*04:01 |
| SARS-cov2-S-Prt-Pep14 | 993 | TRFQTLLALHRSYLTPG DSSSGW | DRB1*04:01 |
| SARS-cov2-S-Prt-Pep15 | 994 | KSFTVEKGIYQTSNFRV Q | DRB1*04:01 |
| SARS-cov2-S-Prt-Pep16 | 995 | KSFTVEKGIYQTSNFRV Q | DRB1*07:01 |
| SARS-cov2-S-Prt-Pep17 | 996 | SASFSTFKCYGVSPTKL | DRB1*07:01 |
| SARS-cov2-S-Prt-Pep18 | 997 | SASFSTFKCYGVSPTKL | DR8 |
| SARS-cov2-S-Prt-Pep19 | 998 | QLIRAAEIRASANLAATK | DRB1*04:01 |
| SARS-cov2-S-Prt-Pep20 | 999 | HWFVTQRNFYEPQII | DRB1*04:01 |
| SARS-cov2-S-Prt-Pep21 | 1000 | NLDSKVGGNYNYLYRL FR | Class II |
| SARS-cov2-S-Prt-Pep22 | 1001 | LLNKHIDAYKTFP | HLADR2, DR3 |
| SARS-cov2-S-Prt-Pep23 | 1002 | LQLPQGTTL | HLA-A*0201 |

TABLE 13-continued

| MHC RESTRICTED SARS-cov2 PEPTIDEs | | | |
|---|---|---|---|
| NAME | SEQ ID NO | SEQUENCE | MHC restriction |
| SARS-cov2-Nucleocapsid-Pep1 | 1003 | ALNTPKDHI | HLA-A*0201 |
| SARS-cov2-Nucleocapsid-Pep2 | 1004 | GDAALALLL | HLA-B*4001 |
| SARS-cov2-Nucleocapsid-Pep3 | 1005 | LLLDRLNQL | HLA-A*0201 |
| SARS-cov2-Nucleocapsid-Pep4 | 1006 | RLNQLESKM | HLA-A*0201 |
| SARS-cov2-Nucleocapsid-Pep5 | 1007 | GMSRIGMEV | HLA-A*0201 |
| SARS-cov2-Nucleocapsid-Pep6 | 1008 | LALLLLDRL | HLA-A*0201 |
| SARS-cov2-Nucleocapsid-Pep7 | 1009 | GDAALALLLL | HLA-A*0201 |
| SARS-cov2-Nucleocapsid-Pep8 | 1010 | LLLLDRLNQL | HLA-A*0201 |
| SARS-cov2-Nucleocapsid-Pep9 | 1011 | TKAYNVTQAF | HLA-B*1525 |
| SARS-cov2-Nucleocapsid-Pep10 | 1012 | NFKDQVILL | HLA-A*2402 |
| SARS-cov2-Nucleocapsid-Pep11 | 1013 | KTFPPTEPK | HLA-A*1101 |
| SARS-cov2-Nucleocapsid-Pep12 | 1014 | MEVTPSGTWL | HLA-B*4001 |
| SARS-cov2-Nucleocapsid-Pep13 | 1015 | TKAYNVTQAF | Class I |
| SARS-cov2-Nucleocapsid-Pep14 | 1016 | NFKDQVILL | A*24:02 |
| SARS-cov2-Membrane-Glycoprt-Pep1 | 1017 | TLACFVLAAV | HLA-A*0201 |
| SARS-cov2-Membrane-Glycoprt-Pep2 | 1018 | GLMWLSYFI | HLA-A*0201 |
| SARS-cov2-Membrane-Glycoprt-Pep3 | 1019 | HLRIAGHHL | HLA-B*1502 |
| SARS-cov2-Membrane-orf1ab-pep1 | 1020 | CLEASFNYL | HLA-A*0201 |
| SARS-cov2-Membrane-orf1ab-pep2 | 1021 | WLMWLIINL | HLA-A*0201 |
| SARS-cov2-Membrane-orf1ab-pep3 | 1022 | ILLLDQALV | HLA-A*0201 |
| SARS-cov2-Membrane-orf1ab-pep4 | 1023 | SACVLAAEC | HLA-A*0201 |
| SARS-cov2-Membrane-orf1ab-pep5 | 1024 | SLPGVFCGV | HLA-A*0201 |
| SARS-cov2-Membrane-orf1b-pep6 | 1025 | TLMNVLTLV | HLA-A*0201 |
| SARS-cov2-Membrane-orf1ab-pep7 | 1026 | SMWALIISV | HLA-A*0201 |
| SARS-cov2-Membrane-orf3a-pep1 | 1027 | RIFTIGTVTLKQGEI | B*58:01 |
| SARS-cov2-Membrane-orf3a-pep1 | 1028 | TVTLKQGEI | B*58:01 |

In some embodiments, the peptides provided herein comprise two or more of the T cell epitopes (e.g., viral epitopes). In some embodiments, the peptides provided herein comprise at least 2, 3, 4, 5, 6, 7, 8, 9, 10, 11, 12, 13, 14, 15, 16, 17, 18, 19 or 20 T cell epitopes. For example, in some embodiments, the peptides provided herein comprise two or more of the T cell epitopes connected by linkers (e.g., polypeptide linkers). In some embodiments, the polypeptide or protein further comprises an intervening amino acid sequence between at least two of the plurality of epitopes. In some embodiments, the intervening amino acids or amino acid sequences are proteasome liberation amino acids or amino acid sequences. Non-limiting examples of proteasome liberation amino acids or amino acid sequences are or comprise AD, K or R. In some embodiments, the intervening amino acids or amino acid sequence are TAP recognition motifs. Typically, TAP recognition motifs may conform to the following formula: (R/N:I/Q:W/Y)n where n is any integer >1. Non-limiting examples of TAP recognition motifs include RIW, RQW, MIW and NQY, In some embodiments, the epitopes provided herein are linked or joined by the proteasome liberation amino acid sequence and, optionally, the TAP recognition motif at the carboxyl terminus of each epitope. Exemplary SARS-cov2 polyepitopes containing proteasome liberation sequences and TAP recognition motifs are presented in SEQ NO: 695 and SEQ ID NO:697.

In an embodiment, the one or more SARS-cov2 polyepitopes are expressed in fusion with a drug inducible protein degradation domain (DIPDD).

In some embodiments, the sequence of the peptides comprises a SARS-cov2 viral protein sequence except for 1 or more (e.g., 1, 2, 3, 4, 5, 6, 7, 8, 9, 10 or more) conservative sequence modifications.

In some embodiments, the peptides provided herein comprise a sequence that is at least 80%, 85%, 90%, 95% or 100% identical to a protein sequence (e.g., the sequence of a fragment of a viral protein).

The peptide can be a chimeric or fusion peptide. Exemplary SARS-cove polyepitopes containing proteasome liberation sequences and TAP recognition motifs are presented in SEQ ID NO: 695 and SEQ ID NO:697. In some embodiments, the peptide provided herein is linked to another peptide comprising a distinct epitope.

In certain aspects, provided herein are nucleic acid molecules encoding the peptides described herein. In some embodiments, the nucleic acid molecule is a vector. In some embodiments, the vector provided herein encodes at least 2, 3, 4, 5, 6, 7, 8, 9, 10, 11, 12, 13, 14, 15, 16, 17, 18, 19 or 20 epitopes provided herein (e.g., epitopes provided in Table 13). In some embodiments, the vector is a viral vector (e.g. a lentiviral vector).

In some embodiments, provided herein are cells that contain a nucleic acid described herein (e.g., a nucleic acid encoding a peptide described herein).

SABR-T Cells

Provided herein are methods of treating cancers, autoimmune diseases (e.g., MS, SAD, IBD) and infectious diseases (e.g., HIV-1, SARS, MERS, SARS-cov2, influenza, EBV, CMV etc.) by administering to the subject allogeneic or autologous SABR-T cells expressing a T cell receptor that specifically binds to an antigen (e.g., a virus peptide antigen) presented on a or major histocompatibility complex (MHC) molecule, and a synthetic antigen binding receptor molecule with the ability to both specifically bind a selected target peptide (e.g., a WT1 peptide, or Ras peptide, or NY-ESO peptide) or protein (e.g., CD19, CD20, CD22, CD33, CD123, Mesothelin, BCMA, CD70, Her2, PSMA, CD38, CD138, MPL etc.) and transduce subsequent activation signals.

In some embodiments, the antigen-specific T cells used for generating the SABR-T cells of the invention are selected from a cell bank or library. Preferably, the MHC is a class I MHC. In certain embodiments, the MHC is a class II MHC and has an a (or α) chain polypeptide that is HLA-DMA, HLA-DOA, HLA-DPA, HLA-DQA or HLA-DRA. In some such embodiments, the class II MHC has a b (or β) chain polypeptide that is HLA-DMB, HLA-DOB, HLA-DPB, HLA-DQB or HLA-DRB. Such T cells, as described herein (e.g., antigen-specific T cells and antigen-specific T cells expressing a SABR), are stored in a cell library or bank before they are administered to the subject.

Also provided herein are APCs that present a peptide described herein (e.g. a peptide comprising a T cell epitope). In some embodiments the APCs are B cells, antigen presenting T-cells, dendritic cells, or artificial antigen-presenting cells (e.g., aK562 cells).

In certain preferred embodiments, the APCs are derived from lymphoblastoid cells, such as BLCLs. Exemplary antigen-presenting BLCLs are described in O'Reily et al., Immunol Res 2007 38:237-250 and Koehne et al., Blood 2002 99: 1730-1740, which are hereby incorporated by reference. Dendritic cells for use in the process may be prepared by taking PBMCs from a patient sample and adhering them to plastic. In some embodiments, the APC is an artificial antigen-presenting cell, such as an aK562 cell.

In certain aspects, provided herein are methods of generating APCs that present the one or more of the T cell epitopes described herein comprising contacting an APC with a SARS-cov2 peptide comprising an epitope and/or with a nucleic acid encoding said epitope. In an embodiment, the SARS-cov2 proteins and/or peptides are presented to APC as fusion with an amphiphile. In some embodiments, the APCs are irradiated. A cell presenting a peptide described herein can be produced by standard techniques known in the art.

In some embodiments, provided herein are T cells (e.g., CD4 T cells and/or CD8 T cells) that express a TCR (e.g., an αβ TCR or γδ TCR) that recognizes a SARS-cov2 peptide described herein presented on a MHC. In some embodiments, the T cell is a CD8 T cell (a CTL) that expresses a TCR that recognizes a SARS-cov2 peptide described herein presented on a class I MHC. In some embodiments, the T cell is a CD4 T cell (a helper T cell) that recognizes a SARS-cov2 peptide described herein presented on a class II MHC.

In some embodiments, provided herein are methods of generating, activating and/or inducing proliferation of SABR-T cells that recognize one or more of the SARS-cov2 epitopes described herein and also express a synthetic antigen binding receptor (e.g., SARS-cov2-specific, antiCD19-SABR-T cells). In some embodiments, a culture (or sample thereof) comprising T cells (i.e., isolated T cells) is incubated in culture with an APC provided herein (e.g., an APC that presents a peptide comprising an SARS-cov2 epitope on a class I MHC complex, such as the virally transduced PBMCs described herein). In some embodiments, the APCs are autologous to the subject from whom the T cells were obtained. In some embodiments, the APCs are not autologous to the subject from whom the T cells were obtained. In some embodiments, the sample containing cells are incubated 2 or more times with APCs provided herein. In some embodiments, the T cells (and/or SABR-T cells) are incubated with the APCs in the presence of at least one cytokine. In some embodiments, the cytokine is IL-2, IL-4, IL-7 and/or IL-15. Similarly, T cell and/or SABR-T cell cultures may be maintained in the presence at least one cytokine, such as IL-2, IL-7 and/or IL-15. Exemplary methods for inducing proliferation of T cells using APCs are provided, for example, in U.S. Pat. Pub. No. 2015/0017723, which is hereby incorporated by reference. In preferred embodiments, such antigen-specific (e.g., SARS-cov2-specific) T cells are transduced with a vector comprising nucleic acid sequence encoding a synthetic antigen binding receptor (SABR).

Exemplary antigens targeted by SABR include, but are not limited to, tumor antigens, i.e., proteins that are produced by tumor cells that elicit an immune response, particularly T-cell mediated immune responses. The additional antigen binding domain can be an antibody or a natural ligand of the tumor antigen. The selection of the additional antigen binding domain will depend on the particular type of cancer to be treated. Tumor antigens are well known in the art and include, for example, Non-limiting examples of target antigens include: CD5; CD19; CD123; CD22; CD30; CD171; CS1 (also referred to as CD2 subset 1, CRACC, MPL, SLAMF7, CD319, and 19A24); C-type lectin-like molecule-1 (CLL-1 or CLECL1); CD33; epidermal growth factor receptor variant III (EGFRviii); ganglioside G2 (GD2); ganglioside GD3 (aNeu5Ac(2-8)aNeu5Ac(2-3)bD-Galp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EPCAM); 137113 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin 132; fibroblast activation protein alpha (FAP); insulin-like growth factor 1 receptor (IGF-1 receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bD-Clalp(1-4)bDGlcp(1-1)Cer); transglutaminase 5 (TGS5); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CM79a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LADE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGEl); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCTA-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYP1B 1); CCCTC-Binding Factor (Zinc Finger Protein)-Like (BORIS or Brother of the Regulator of Imprinted Sites), Squamous Cell Carcinoma Antigen Recognized. By T Cells 3 (SART3); Paired box protein Pax-5 (PAX5); proacrosin binding protein sp32 (OY-TESl); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RUE); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A), bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1); MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGLl1, TCRgamma-delta, NKG2D, CD32 (FCGR2A), Tn ag, Tim1-/HVCR1, CSF2RA (GM-CSFR-alpha), TGF-betaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRC5D, Claudin18.2 (CLD18A2 or CLDN18A.2), P-glycoprotein, STEAP1, Liv1, Nectin-4, Cripto, gpA33, BST1/CD157, low conductance chloride channel, the antigen recognized by TNT antibody, CD229, Toso, BAFF-R, SARS-cov2 Spike glycoprotein and any combination thereof.

Also disclosed are polynucleotides and polynucleotide vectors encoding the disclosed target-specific SABRs that allow expression of said SABRs in the disclosed immune effector cells (e.g., T cells, e.g., SARS-cov2 specific T cells).

Nucleic acid sequences encoding the disclosed SABRs, and regions thereof, can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

Expression of nucleic acids encoding SABRs is typically achieved by operably linking a nucleic acid encoding the SABR polypeptide to a promoter, and incorporating the construct into an expression vector. The disclosed nucleic acid can be cloned into a number of types of vectors.

In another aspect, the disclosure provides an isolated SABR polypeptide molecule comprising one or more antigen binding domains (e.g., antibody or antibody fragment, a ligand or a receptor) that bind to antigens as described herein, and are jointed to one or more T cell receptor constant chains.

In order to assess the expression of a SABR polypeptide or portions thereof, the expression vector to be introduced into a cell (e.g., an antigen-specific T cell) can also contain either a selectable marker gene or a reporter gene or both to facilitate identification and selection of expressing cells from the population of cells sought to be transfected or infected through viral vectors. In some embodiments, the SABR-encoding vector comprises a nucleic acid sequence encoding an antibiotic-resistance gene such as blasticidin resistance (Blast) or puromycin resistance (PAC). In some such embodiments, the SABR T cells (e.g., the antigen-specific SABR T cells) are cultured in the presence of the selectable marker (e.g., blasticidin or puromycin), thereby allowing for selection and expansion of SABR-expressing T cells described herein.

Also provided herein are genetically engineered cells (such as T cells, NK cells, iPSC) comprising vectors encoding nucleic acids encoding SABR (including functional variants). In one embodiment, the cell is selected from the group consisting of a T cell, a Natural Killer (NK) cell, a cytotoxic T lymphocyte (CTL), a regulatory T cell, hematopoietic stem cells and/or pluripotent embryonic/induced stem cells. The cell can be an immune effector cell (e.g., a T cell or a NKT cell, or a combination thereof) or a stem/progenitor cell (e.g., iPSC) that can give rise to an immune effector cell or a synthetic T cell.

In some embodiments, the cell is an immune cell. Non-limiting examples of immune cells include T-cells and NK-cells. Further, non-limiting examples of T-cells include Tregs, CD8+ T cells, and CD4+ T cells. In one embodiment, the cell is a human T cell. In some embodiments, the cell is a human cell. In some embodiments, the cell is a dog cell.

In one embodiment, the cell is a T cell and the T cell is deficient in one or more of endogenous T cell receptor chains. In some embodiments, the cell in the methods is deficient in constant chains of endogenous T cell receptor α, β1, β2, pre-TCRα, γ or δ or combination thereof. In some embodiments, the cell in the methods is deficient in HLA antigens. In some embodiments, the cell in the methods is deficient in β2 microglobulin.

In some embodiments, the methods provided herein are directed to treating a cancer, infection (e.g., SARS-cov2) and/or an autoimmune disorder in a subject by administering to the subject autologous or allogeneic SABR-T cells as provided herein.

The methods of the present disclosure rely, in part, on the principles of T cell restriction to specific target antigens. For example, and without limitation, products and preparations comprising donor-derived CTLs targeted against antigens expressed by a virus, such as SARS-cov2, can be elicited on targeted antigen-presenting (e.g., stimulator) cell lines, including SARS-cov2-transformed B Lymphoblasts (BLCLs) or K562 cells expressing SARS-cov2 antigens. With respect to the disclosed virus-antigen-specific SABR T cell preparations, the target cells and/or recipients of the SABR-T products made by the methods provided herein, may be autologous or allogeneic. In an embodiment, in the case of allogeneic targets, the human leukocyte antigen (HLA) identity of the donor must be known and matched to the HLA identity of the target (i.e., cultured cell lines and/or recipients).

A preparation of SABR T cells may have a mixture of antigen-specific and non-specific CTLs.

Target cells for the assays disclosed herein are typically selected for their uniform phenotype and availability in large quantities. In certain embodiments, the target cell lines are antigen-presenting cells (APCs). In some such embodiments, the target cell lines are B cells, antigen-presenting T-cells, dendritic cells, or artificial antigen-presenting cells (e.g., aK562 cells). In certain embodiments, the target cell lines comprise peripheral blood mononuclear cells (PBMCs). In some such embodiments, the target cell lines are lymphoblasts. In certain preferred embodiments, the target cell lines are virally transformed. In preferred embodiments, the target cell lines comprise each of Phytohemagglutinin-stimulated peripheral blood lymphocytes (PHA-blasts/PHAbs) and Epstein-Barr virus-transformed B-lymphoblastoid cell lines (BLCLs).

In some embodiments, target cell lines comprise allogeneic cells. In some such embodiments, target cells carry Human Leukocyte Antigen (HLA) alleles that do not match the HLA alleles to which the SABR-T CTLs of the preparation are restricted. In other such embodiments, the target cells carry HLA alleles that are a partial match to the HLA alleles to which the SABR-T CTLs of the preparation are restricted. In still other such embodiments, the target cells carry HLA alleles that are a match to the HLA alleles to which the SABR-T CTLs of the preparation are restricted. In preferred embodiments, the SABR-T CTLs are restricted to HLA alleles of the target cells which encode MHC Class I proteins.

In other embodiments, the target cell lines comprise autologous cells. In some such embodiments the SABR-T CTL preparation is identified as suitable for use against target cells by confirming the ability of the preparation to lyse two or more autologous target cell lines at, above, or below predetermined thresholds.

In certain embodiments, the autologous or allogeneic SABR-T cells comprise central memory T cells (TCM e.g., at least 60%, 70%, 80% of the cells are Tcm cells. In some embodiments, the autologous or allogeneic SABR-T cells comprise a ratio of central memory T cells to effector memory cells (TCM:TEM) from at least 1:1 to at least 3:1, e.g. at least 1:1, 1.4:1, 2.5:1, or 3:1). In some such embodiments, the autologous or allogeneic SABR-T cells are predominantly CD4+ T cells. In some embodiments, the autologous or allogeneic SABR-T cells comprise at least 80% CD4+ SABR-T cells and at least 15% CD8+ SABR-T cells). In some embodiments, the autologous or allogeneic SABR-T cells comprise a ratio of CD4+ T cells to CD8+ T cells from at least 1:1 to at least 3:1, e.g., at least 1:1, 1.4:1, 2.5:1, or 3:1. In some of the methods described herein, allogenic T cells are selected from a cell bank (e.g., a pre-generated third party donor derived bank of epitope-specific T cells).

In some embodiments, provided herein are methods of treating a cancer in a subject by administering to the subject a therapeutic SABR-T cell preparation as described herein. In some embodiments, the methods provided herein can be used to treat any cancer.

In certain embodiment, the method is used to treat an infectious disease or autoimmune disease.

The selected dosage level will depend upon a variety of factors including the activity of the particular agent employed, the route of administration, the time of administration, the rate of excretion or metabolism of the particular compound being employed, the duration of the treatment, other drugs, compounds and/or materials used in combination with the particular compound employed, the age, sex, weight, condition, general health and prior medical history of the patient being treated, and like factors well known in the medical arts.

In some embodiments, the methods described herein include selecting allogeneic T cells from a cell bank (e.g., a pre-generated third party donor derived bank of epitope specific T cells). In some embodiments, the T cells are selected because they express a TCR restricted to a class I MHC that is encoded by an HLA allele that is present in the subject. In some embodiments, the T cells are selected if the T cells and subject share at least 2 (e.g., at least 3, at least 4, at least 5, at least 6) HLA alleles and the T cells are restricted through a shared HLA allele. In some embodiments, the method comprises testing the TCR repertoire of the pre-generated third-party-donor-derived epitope-specific T cells (i.e., allogeneic T cells) with flow cytometry. In some embodiments, epitope-specific T cells are detected using a tetramer assay, an ELISA assay, a western blot assay, a fluorescent microscopy assay, an Edman degradation assay and/or a mass spectrometry assay (e.g., protein sequencing). In some embodiments, the TCR repertoire is analyzed using a nucleic acid probe, a nucleic acid amplification assay and/or a sequencing assay.

In some embodiments, provided herein are compositions (e.g., therapeutic compositions) comprising T cells and/or APCs provided herein used to treat and/or prevent an autoimmune disease in a subject by administering to the subject an effective amount of the composition.

According to the invention, a lymphodepleting treatment is generally performed before administering the engineered immune cells to the patients. Such lymphodepleting treatment generally combines fludarabine and cyclophosphamide. As a preferred embodiment of the present invention, the lymphodepleting treatment can comprise an anti-CD52 antibody, such as alemtuzumab, alone or in combination. The lymphodepletion regimen may for instance combine cyclophosphamide, typically for 1 to 3 days, fludarabine for 1 to 5 days, and alemtuzumab from 1 to 5 days. More specifically, the lymphodepletion regimen can combine between cyclophosphamide 50 and 70 mg/kg/day, fludarabine between 20 and 40 mg/m2/day, and alemtuzumab 0.1 to 0.5 mg/kg/day.

According to the present methods, the above induction chemotherapy treatment and lymphodepletion steps are usually followed by a cell immunotherapy treatment using engineered immune cells.

The immune cells may originate from the patients (autologous engineered cells) or from donors (allogenic engineered immune cells). They are generally primary cells obtainable from leukapheresis or derived from iPS cells or cell lines. These Immune cells are generally population of lymphocytes, preferably NK or T-cells. The engineered immune cells of the present invention preferably express recombinant TCR or a SABR specific for an antigen marker. By "recombinant TCR" is meant that an exogenous TCR with a different specificity is introduced or expressed into the cell that partially or completely replace the expression of the endogenous TCR.

In one embodiment, the method includes administering a cell expressing the SABR molecule, as described herein, in combination with an agent which enhances the activity of a SABR-expressing cell, wherein the agent is a cytokine, e.g., IL-2, IL-7, IL-15, IL-21, or a combination thereof. The cytokine can be delivered in combination with, e.g., simultaneously or shortly after, administration of the SABR-expressing cell.

In other embodiments, the cells expressing a SABR molecule are administered in combination with an agent that ameliorates one or more side effects associated with administration of a cell expressing a SABR molecule.

SABR Targeting SARS-Cov2

In some embodiment, the disclosure also provides isolated nucleic acids encoding SABR, wherein the antigen specific domain of the SABR targets the spike glycoprotein of SARS-cov2. In an embodiment, the disclosure provides an isolated nucleic acid encoding SABR, wherein the antigen specific domain of the SABR targets the Receptor Binding domain of the spike glycoprotein of SARS-cov2. In exemplary embodiments, the nucleic acid sequences of SABR targeting the spike glycoprotein of SARS-cov2 are set forth in SEQ ID NOs: 310-365; 367-422; 424-479 (Tables 9-11).

In some embodiment, the disclosure also provides isolated polypeptides encoding SABR, wherein the antigen specific domain of the SABR targets the spike glycoprotein of SARS-cov2. In an embodiment, the disclosure provides isolated polypeptides encoding SABR, wherein the antigen specific domain of the SABR targets the Receptor Binding domain of the spike glycoprotein of SARS-cov2. In exemplary embodiments, the polypeptide sequences of SABR targeting the spike glycoprotein of SARS-cov2 are set forth in SEQ ID NOs: 780-835; 837-892; 894-949 (Tables 9-11).

The disclosure also provides novel vL, vH and scFv fragments targeting the spike glycoprotein of SARS-cov2 that can be used in the construction of single and double chain SABRs, including $2^{nd}$ generation CARs, single and double chain SIRs, single and double chain cTCRs, Ab-TCR, TFPs, TAC and the like. Exemplary vL, vH and scFv fragments and their CDRs are listed in Table 7A.

In some embodiments, the antigen specific domains of the SABRs targeting the Spike glycoprotein comprise one or more $V_L$ fragments described in Table 7A. In some embodiments, the polynucleotides encoding the one more $V_L$ fragments comprise, consist of or consist essentially of sequences set forth in any one or more of SEQ ID NOs: 213 to 215. In some embodiments, the polypeptides encoding the one more $V_L$ fragments comprise, consist of or consist essentially of sequences set forth in any one or more of SEQ ID NOS: 683 to 685 or sequences with 70-99% identity to sequences set forth in any one or more of SEQ ID NOS: 683 to 685 or sequences with 70-99% identity in the three complementarity determining regions (CDRs) to the sequences set forth in any one or more of SEQ ID NOS: 683 to 685 or sequences with less than 3 substitutions in the three CDRs of the sequences set forth in any one or more of SEQ ID NOS: 683 to 685 or sequences that bind to the same target antigens or the same epitopes on the target antigens as the sequences set forth in any one or more of SEQ ID NOS: 683 to 685. In some embodiments, the antigen specific domains of the CARs comprise one or more $V_H$ fragments described in Table 7a. In some embodiments, the polynucleotides encoding the one more $V_H$ fragments comprise, consist of or consist essentially of sequences set forth in any one or more of SEQ ID NOS: 217-219. In some embodiments, the polypeptides encoding the one more $V_H$ fragments comprise, consist of or consist essentially of sequences set forth in any one or more of SEQ ID NOS: 687-689 or sequences with 70-99% identity to sequences set forth in any one or more of SEQ ID NOS: 687-689 or sequences with 70-99% identity in the three complementarity determining regions (CDRs) to the sequences set forth in any one or more of SEQ ID NOS: 687-689 or sequences with less than 3 substitutions in the three CDRs of the sequences set forth in any one or more of SEQ ID NOS: 687-689 or sequences that bind to the same target antigens or the same epitopes on the target antigens as the sequences set forth in any one or more of SEQ ID NOS: 687-689.

Also provided are functional variants of the SABRs targeting SARS-cov2 described herein, which have substantial or significant sequence identity or similarity to a parent SABR, which functional variant retains the biological activity of the SABR of which it is a variant. Functional variants encompass, for example, those variants of the SABR described herein (the parent SABR) that retain the ability to recognize SARS-cov2-infected cells to a similar extent, the same extent, or to a higher extent, as the parent SABR. In reference to the parent SABR, the functional variant can, for instance, be at least about 30%, about 50%, about 75%, about 80%, about 85%, about 90%, about 91%, about 92%, about 93%, about 94%, about 95%, about 96%), about 97%, about 98%, about 99% or more identical in amino acid sequence to the parent SABR.

A functional variant can, for example, comprise the amino acid sequence of the parent SABR with at least one conservative amino acid substitution. Alternatively or additionally, the functional variants can comprise the amino acid sequence of the parent SABR with at least one non-conservative amino acid substitution. In this case, it is preferable for the non-conservative amino acid substitution to not interfere with or inhibit the biological activity of the functional variant. The non-conservative amino acid substitution may enhance the biological activity of the functional variant, such that the biological activity of the functional variant is increased as compared to the parent SABR.

The SABRs (including functional portions and functional variants) can be of any length, i.e., can comprise any number of amino acids, provided that the SABRs (or functional portions or functional variants thereof) retain their biological activity, e.g., the ability to specifically bind to SARS-cov3 spike glycoprotein, detect SARS-cov2 infected cells in a mammal, or treat or prevent SARS-cov2 associated disease (e.g., COVID-19) in a mammal, etc. For example, the SABR can be about 300 to about 5000 amino acids long, such as 300, 400, 500, 600, 700, 800, 900, 1000 or more amino acids in length.

Further provided herein are vectors encoding nucleic acids encoding SABR, wherein the antigen specific domain of the SABR targets spike glycoprotein of SARS-cov2.

Also provided herein are genetically engineered cells (such as T cells, NK cells, iPSC) comprising vectors encoding nucleic acids encoding SABR (including functional variants), wherein the antigen specific domain of the SABR targets spike glycoprotein of SARS-cov2. In one embodiment, the cell is selected from the group consisting of a T cell, a Natural Killer (NK) cell, a cytotoxic T lymphocyte (CTL), a regulatory T cell, hematopoietic stem cells and/or pluripotent embryonic/induced stem cells. The cell can be an immune effector cell (e.g., a T cell or a NKT cell, or a combination thereof) or a stem/progenitor cell (e.g., iPSC) that can give rise to an immune effector cell or a synthetic T cell.

In some embodiments, the cells are a cell line. Exemplary cell lines that can be used to express a SABR of the disclosure targeting the spike glycoprotein of SARS-cov2 include NK92, NK92MI and the like.

In another aspect, the invention relates to a pharmaceutical composition comprising a cell or cell population (such as T cells, NK cells, iPSC) comprising vectors encoding nucleic acids encoding SABR, wherein the antigen specific domain of the SABR targets spike glycoprotein of SARS-cov2.

Cells that express a SABR of the invention are used in the treatment and prevention of SARS-cov2 infection and associated complications (e.g., COVID-19).

The disclosure provides methods of prevention and treatment of complications (e.g., COVID-19) arising from infection with viruses SARS-cov2 by treatment with a pharmaceutical composition targeting the spike glycoprotein of SARS-cov2 and comprising the cells described herein, the nucleic acids described herein, the polypeptides encoded by the nucleic acids described herein or vectors comprising the nucleic acids described herein, and a pharmaceutically acceptable carrier.

The invention thus relates to methods for the prevention and/or treatment of COVID-19, comprising administering to a subject a cell or cell population comprising a SABR as described herein, said method comprising administering, to a subject in need thereof, a pharmaceutically active amount of a cell and/or of a pharmaceutical composition of the invention. The invention also relates to a SABR, a cell or cell population comprising a SABR as described herein for use in therapy.

In another aspect, the invention relates to a method of providing an SARS-cov2 immunity in a subject, the method comprising administering to the mammal an effective amount of a cell or cell population genetically modified to express a SABR of the invention, wherein the antigen binding domain of SABR binds to spike glycoprotein of SARS-cov2.

In another aspect, the invention relates to a method for producing a genetically modified cell or cell population comprising expressing in said cell or cell population a SABR nucleic acid construct of the invention. The method may include introducing into the cell a nucleic acid as described herein (e.g., an in vitro transcribed RNA or synthetic RNA; an mRNA sequence encoding a SABR polypeptide as described herein). In embodiments, the RNA expresses the SABR polypeptide transiently. In one embodiment, the cell is a cell as described herein, e.g., an immune effector cell (e.g., T cells or NK cells, or cell population). Cells produced by such methods are also within the scope of the invention.

In another aspect, the invention relates to an ex vivo method for generating a population of cells for use in adaptive immunotherapy comprising transforming said cell with a SABR of the invention, Cell Lines for Sars-Cov2 Research and Development and Quality Control and Methods of Using the Same The disclosure also provides polynucleotides, polypeptides, vectors and primary cells and cell lines that express the different SARS-cov2 antigens and polyepitopes, singly or in combination. Exemplary SARS-cov2 antigens include spike glycoprotein and a fragment thereof, nucleocapsid protein and a fragment thereof membrane glycoprotein and a fragment thereof. Exemplary cell lines include K562, 293, VeroE6 and the like.

In an embodiment, the primary cells and cell line encodes poly epitope derived from different antigens of SARS-cov2, such as spike glycoprotein, nucleocapsid and membrane glycoprotein and/or orf 1 ab. In an embodiment, the SARS-cov2 antigens and polypeptides are expressed in the primary cells and cell lines stably. In an embodiment, the SARS-cov2 antigens and polypeptides are expressed in the primary cells and cell lines transiently. In an embodiment, the SARS-cov2 antigens and polypeptides are expressed in the primary cells and cell lines using a constitutive promoter (MND promoter, EF1α promoter, CMV promoter etc.). In an embodiment, the SARS-cov2 antigens and polypeptides are expressed in the primary cells and cell lines using an inducible promoter (e.g., tetracycline promoter). In an embodiment, the SARS-cov2 antigens and polypeptides are expressed in the primary cells and cell lines following infection with SARS-cov2. The disclosure also provides a method for the use of the primary cells and cell lines as antigen presenting cells (APC) for generation and expansion of SARS-cov2 reactive T cells. The disclosure also provides a method for the use of the primary cells and cell lines as antigen presenting cells (APC) for monitoring immune response to SARS-cov2 and for measuring the efficacy of therapeutics targeting SARS-cov2 (e.g., SARS-cov2 directed SABR, antibodies, antibody drug conjugates and the like).

In an embodiment, the primary cells and cell lines expressing the SARS-cov2 antigens and polyepitopes, singly or in combination, also express a luciferase. In an embodiment, the luciferase is a thermostable luciferase. Exemplary thermostable luciferase include marine luciferase (e.g., Gluc, NLuc, PaLuc, TurboLuc and the like) and thermostable beetle luciferase such as (e.g., LucPPE and its engineered variants such as LucPPe-146-1H2, LucPPe-133-1B2, LucPPe-78-0B10, LucPPe49-7C6A and LucPpL-81-6G1. The nucleic acid and amino acid. SEQ ID of exemplary luciferases are provided in Table 2.

Also provided herein are cell lines and/or compositions comprising primary cells and cell lines wherein the cell lines express one or more of SARS-cov2 antigens, antigen fragments, epitopes, polyepitopes, and also coexpress the non-secretory forms of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1, CBGRluc, thermostable alkaline phosphatase or homologs or orthologs or mutants or derivatives thereof for the purpose of use as a target cell line for measuring cytotoxicity.

Also provided herein are primary cells and/or compositions comprising primary cells wherein the primary cells express one or more of SARS-cov2 antigens, antigen fragments, epitopes, polyepitopes, and also coexpress the non-secretory forms of GLuc, NLuc, MLuc7, HTLuc, PaLuc 1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or derivatives thereof.

In various embodiments, the primary cell and cell lines are modified and/or selected to lack the expression of one or more antigens.

The disclosure also provides a method for use of the primary cells and cell lines for measuring the cytotoxicity of SARS-cov2 directed therapeutics (e.g., T cells, SABR-T, antibodies, bispecific antibodies etc) using the non-radioactive luciferase based cytotoxicity assay (Matador cytotoxicity assay) as described in PCT/US17/52344, which is incorporated in its entirety by reference herein.

The methods include providing a target cell (e.g., a primary cell or cell line) that has been engineered to express a SARS-cov2 protein (e.g., Spike glycoprotein) or a fragment thereof and is optionally engineered to express intracellularly a reporter; exposing the target cell to SARS-cov2 directed agent capable of modulating cytotoxicity; and assaying the cytotoxicity of SARS-cov2 directed agent. In an embodiment, the cytotoxicity of the agent is measured by measuring the activity of the reporter. In one embodiment, the reporter is not expressed endogenously by the target cell. In another embodiment, the reporter is expressed endogenously by the target cell at a level lower than what is achieved by engineered expression. In an embodiment, the reporter is a thermostable luciferase. In one embodiment, a change in reporter activity relative to a reference value is indicative of the agent being able to modulate cytotoxicity of the target cell. In one embodiment, a change in reporter activity is an increase in reporter activity relative to a reference value. In some embodiments, the reporter is expressed endogenously by the target cell at a level that is at least 10-25%, 25-50%, 50-75% or 75-100% lower than what is achieved by engineered expression.

In on embodiment, the reporter activity is assayed in the cell media containing the target cells. In another embodiment, the reporter activity is assayed in the cell supernatant that is free of the target cells.

In various embodiments, the cytotoxicity of an agent is measured by obtaining (assaying) the reporter activity in cell pellet and cell free supernatant and normalizing the reporter activity measured in the cell free supernatant. In various embodiments, normalizing comprises dividing the activity in the cell free supernatant by the reporter activity measured in the cell pellet In various embodiments, the reporter is a non-secretory form of an enzyme that is stable under the assay conditions at 37° C. for more than 15 min, for more than 30 min, for more than 1 hour, for more than 2 hours, for more than 3 hours, for more than 4 hours, for more than 12 hours, 24 hours, for more than 36 hours, for more than 48 hours or for at least 96 hours.

In various embodiments, the reporter is a non-secretory form of a luciferase. In some embodiments, the non-secretory form of luciferase is obtained from copepods, deep sea shrimp, beetle, firefly, or homologs or orthologs thereof or mutants or variants or derivatives thereof.

In exemplary embodiments, the copepods are selected from the group consisting of any one or more of *Gaussia princeps, Pleuromamma abdominalis, Metridia pacifica, Metridia curticauda, Metridia asymmetrica, Metridia okhotensis, Metridia longa, Lucicutia ovaliformis, Heterorhabdus tanneri*, and *Pleuromamma scutullata.*

In various embodiments, the luciferase is any one or more of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), Lucia Luc, *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or variants or derivatives thereof.

In various embodiments, the reporter is a non-secretory form of a luciferase obtained from copepods, deep sea shrimp, beetle, firefly or homologs or orthologs thereof or mutant or derivatives thereof and the reporter activity is assayed by exposing the target cells to a luciferase specific substrate.

In various embodiments, the luciferase-specific substrate is coelentrazine or an imidazopyrazinone substrate (furimazine) or a derivative thereof. In one embodiment, the luciferase-specific substrate is D-luciferin or a derivative thereof.

In one embodiment, the reporter is a thermostable luciferase. In one embodiment, the reporter is a thermostable beetle luciferase. In an embodiment, the thermostable beetle luciferase is obtained from *Photuris pennsylvanica* and *Pyrophorus plagiothalamus*

In some embodiments, the reporter is a non-secretory form of an alkaline phosphatase. In one embodiment, the alkaline phosphatase is a heat-stable alkaline phosphatase.

In some embodiments, the reporter is a non-secretory form of a fluorescent protein. In one embodiment, the non-secretory form of a fluorescent protein is green fluorescent protein.

In one embodiment, the target cells express a single type of reporter. In another embodiment, the target cells express more than one type of reporter. In various embodiments, the activity of the two reporters can be measured independent of each other either simultaneously or sequentially.

In some embodiments, the substrate for one of the reporters is coelentrazine or an imidazopyrazinone substrate (e.g., furimazine) or a derivative thereof and the substrate for the other reporter is D-luciferin or a derivative thereof.

In some embodiments, the substrate for one of the reporters is coelentrazine or an imidazopyrazinone substrate (e.g., furimazine) or a derivative thereof and the substrate for the other reporter is pNNP or a derivative thereof.

In some embodiments, the target cells expressing two or more reporters are mixed together prior to the assay.

In some embodiments, the reference value is the reporter activity in any one or more of (i) target cells that do not express reporter, (ii) target cells that express reporter but are not treated with the test agent(s); (iii) the target cells that are left untreated; (iv) target cells that are not treated with the substrate for the reporter, or (iii) a combination thereof.

In some embodiments, the agent capable of modulating cytotoxicity is any one or more of an antibody, small molecule, chemical compound, radiation agent, cytotoxic cells, biologics or combinations thereof.

In some embodiments, the cytotoxic cells are any one or more of T cells, NK cells, PBMCs or combinations thereof. In some embodiments, the cytotoxic cells are modified to express a chimeric or synthetic receptor or a T cell receptor.

In some embodiments, the antibodies are any one or more of chimeric antibodies, human antibodies, humanized antibodies, bispecific antibodies, bispecific T cell engager, DART, antibody drug conjugates or combination thereof.

In some embodiments, the reporter is expressed in cells by any one or more of plasmid vector, adenoviral vector, adenoassociated viral vector, sleeping beauty transposon, piggyback transposon, pCMV (cytomegalovirus) vectors, vaccinia virus vectors, retroviral vectors, lentiviral vectors, SV40 virus vectors, transfection of naked DNA or transfection of in vitro transcribed RNA. In some embodiments, the reporter is expressed using a non-vector method. In some embodiments, the reporter is expressed from a foreign promoter. In some embodiments, the reporter is expressed from a natural promoter.

In some embodiments, the target cells are exposed to the test agent in vitro. In some embodiments, the target cells are exposed to the test agent in vivo.

In some embodiments, the assay is performed in vitro. In some embodiments, the assay is performed in a high throughput fashion. In some embodiments, the assay is performed in vivo. In some embodiments, the target cells are present in a transgenic animal. In some embodiments, the assay is performed to identify agents that increase, decrease or have no effect on the cytotoxicity of an agent on a target cell. In some embodiments, the assay is performed with one or more agents used alone or in combination.

In some embodiments, the non-secretory form of the reporter is expressed using vectors encoding the non-secretory forms of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), Lucia Luc, *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or derivatives thereof.

In some embodiments, the target cell is a cell line expressing the non-secretory forms of GLuc, NLuc, MLuc7, HTLuc, PaLuc 1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1, CBGRluc, thermostable alkaline phosphatase or homologs or orthologs or mutants or derivatives or variant thereof.

In some embodiments, the target cell is a primary cell expressing the non-secretory forms of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or derivatives thereof.

In some embodiments, the target cell has been modified and/or selected to lack the expression of one or more antigens. In some embodiments, the target cell has been modified and/or selected to express one or more antigens. In an embodiment, the target cell lines is engineered or modified to express one or more of the SARS-cov2 antigens, epitopes, polyepitopes or fragments thereof. The nucleic acid and amino acid SEQ ID NO of exemplary SARS-cov2 antigens, epitopes, polyepitopes or fragments are provided in Table 7B. In an embodiment, the target cell line is engineered or modified to express one or more of the SARS-cov2 receptors or fragments thereof. Exemplary SARS-cov2 receptor includes ACE2 (SEQ ID NO:235 and 705). In an embodiment, the target cell lines is engineered or modified to express one or more genes that enhance the entry and/or replication of SARS-cov2 (e.g. TMPRSS2; SEQ ID NO: 236 and 706).

Further provided herein are kits comprising components for assessing cytotoxicity of an agent targeting SARS-cov2. In various embodiments, the kits include target cells (for example, cells engineered to express intracellularly one or more reporters and/or cell lines expressing one or more reporters and/or primary cells expressing one or more reporters), and substrates for activating the reporter. The target cells, reporters and substrates are as described herein. In various embodiments, the kits further comprise instructions for use of the kit.

Engineered Cell Lines Stably Expressing Thermostable Luciferase for Measuring Viral Infectivity and Cytopathic Effect.

The disclosure provides cells and cell lines for testing the infection by viruses (e.g., SARS-cov2) using Matador assays. The method includes expression of a reporter in target cells in a manner so that it is preferentially retained within the healthy cells but is either released from virally infected dead and dying cells or whose activity can be preferentially measured in dead and dying cells. In one embodiment, the inventive method measures the activity of the reporter that has been released from the dead and dying cells. In some embodiments, the reporters are any one or more of: 1) non-secreted forms of luciferases from the copepods, such as *Gaussia princeps, Pleuromamma abdominalis, Metridia pacifica, Metridia curticauda, Metridia asymmetrica, Metridia okhotensis, Metridia longa, Lucicutia ovaliformis, Heterorhabdus tanneri, Pleuromamma scutullata* or their homologs; 2) engineered luciferase reporters from deep sea shrimp, such as NanoLuc; 3) *Renilla* luciferase; 4) beetle luciferases, including firefly luciferases and engineered variants such as LucPPe-146-1H2. Other reporters, such as Green Fluorescent Protein, mCherry, and heat-stable alkaline phosphatase may also be used with the assays described herein. Vectors for expressing the reporter genes in stable and transient fashion, engineered cell lines stably expressing the reporter genes, and kits for practicing the invention are also disclosed. In some embodiments, the methods described herein measure the activity of the reporter inside dead and dying cells by addition of a substrate or a cofactor that is required for the activity of the reporter and which is excluded from the healthy cells but preferentially enters dead and dying cells. The method can be used to measure the titer of a virus.

Provided herein are methods for assessing infectivity and cytopathogenicity of a virus. The methods include providing a target cell that is permissive for virus infection and has been engineered to express intracellularly a reporter; exposing the target cell to an agent capable of modulating cytotoxicity; and assaying the activity of the reporter. In one embodiment, a change in reporter activity relative to a reference value is indicative of the presence of the virus. In one embodiment, a change in reporter activity is an increase in reporter activity relative to a reference value. In some embodiments, the reporter is expressed endogenously by the target cell at a level that is at least 10-25%, 25-50%, 50-75% or 75-100% lower than what is achieved by engineered expression.

In on embodiment, the reporter activity is assayed in the cell media containing the target cells. In another embodiment, the reporter activity is assayed in the cell supernatant that is free of the target cells.

In various embodiments, the infectivity of a virus or a preparation containing a virus is measured by obtaining (assaying) the reporter activity in cell pellet and cell free supernatant and normalizing the reporter activity measured in the cell free supernatant. In various embodiments, normalizing comprises dividing the activity in the cell free supernatant by the reporter activity measured in the cell pellet.

In various embodiments, the reporter is a non-secretory form of an enzyme that is stable under the assay conditions at 37° C. for more than 15 min, for more than 30 min, for more than 1 hour, for more than 2 hours, for more than 3 hours, for more than 4 hours, for more than 12 hours, 24 hours, for more than 36 hours, for more than 48 hours or for at least 96 hours.

In various embodiments, the reporter is a non-secretory form of a luciferase. In some embodiments, the non-secretory form of luciferase is obtained from copepods, deep sea shrimp, beetle, firefly, or homologs or orthologs thereof or mutants or variants or derivatives thereof. In exemplary embodiments, the copepods are selected from the group consisting of any one or more of *Gaussia princeps, Pleuromamma abdominalis, Metridia pacifica, Metridia curticauda, Metridia asymmetrica, Metridia okhotensis, Metridia longa, Lucicutia ovaliformis, Heterorhabdus tanneri,* and *Pleuromamma scutullata.*

In various embodiments, the luciferase is any one or more of GLuc, NLuc, MLuc7, HTLuc, PaLuc1, PaLuc2, MpLuc1, McLuc1, MaLuc1, MoLuc1, MoLuc2, MLuc39, PsLuc1, LoLuc1-3, HtLuc2, TurboLuc16 (TLuc), Lucia Luc, *Renilla* Luc, Firefly luciferase (FfLuc or Fluc), LucPPe-146-1H2, LucPPe-133-1B2, LucPPe-78-0B10, LucPPe49-7C6A, LucPpL-81-6G1 or CBGRluc or homologs or orthologs or mutants or variants or derivatives thereof.

In various embodiments, the reporter is a non-secretory form of a luciferase obtained from copepods, deep sea shrimp, beetle, firefly or homologs or orthologs thereof or mutant or derivatives thereof and the reporter activity is assayed by exposing the target cells to a luciferase specific substrate. In various embodiments, the luciferase-specific substrate is coelentrazine or an imidazopyrazinone substrate (furimazine) or a derivative thereof. In one embodiment, the luciferase-specific substrate is D-luciferin or a derivative thereof.

In one embodiment, the reporter is a thermostable luciferase. In one embodiment, the reporter is a thermostable beetle luciferase. In an embodiment, the thermostable beetle luciferase is obtained from *Photuris pennsylvanica* and *Pyrophorus plagiothalamus.*

In some embodiments, the reference value is the reporter activity in any one or more of (i) target cells that do not express reporter, (ii) target cells that express reporter but are not infected with a virus (s); (iii) the target cells that are left untreated; (iv) target cells that are not treated with the substrate for the reporter, or (iii) a combination thereof.

In some embodiments, the target cells are exposed to the test agent in vitro. In some embodiments, the target cells are exposed to the test agent in vivo. In some embodiments, the assay is performed in vitro. In some embodiments, the assay is performed in a high throughput fashion. In some embodiments, the assay is performed in vivo.

In an embodiment, the cell line is any cell line that is capable of supporting the candidate viral infection. In an exemplary embodiment, the virus is a coronavirus (e.g., SARS-cov2) and the cell line is one or more of the following, but not limited to, VERO, VERO-E6, HEK-293, BGM, COS, CV-1, FRhK, LLC-MK2, MA-104, MEK, pCMK, HepG2, Huh-7 or RK-13. In some embodiments, the target cell is a primary cell (e.g., airway epithelial cells). In an exemplary embodiment, the cells are primary airway epithelial cells.

In some embodiments, the target cell has been modified and/or selected to lack or enhance the expression of one or more antigens. The nucleic acid and amino acid SEQ ID NO of exemplary SARS-cov2 antigens, epitopes, polyepitopes or fragments are provided in Table 7B. In an embodiment, the target cell line is engineered or modified to express one or more of the SARS-cov2 receptors or fragments thereof. Exemplary SARS-cov2 receptor includes ACE2 (SEQ ID NO:235 and 705). In an embodiment, the target cell lines is engineered or modified to express one or more genes that enhance the entry and/or replication of SARS-cov2 (e.g. TMPRSS2; SEQ ID NO: 236 and 706).

Further provided herein are kits comprising components for assessing viral (e.g., SARS-cov2) infectivity and cytopathic effects. In various embodiments, the kits include target cells (for example, cells engineered to express intracellularly one or more reporters and/or cell lines expressing one or more reporters and/or primary cells expressing one or more reporters), and substrates for activating the reporter.

Topanga Reagent Based on SARS-Cov2 Spike Glycoprotein and Nucleocapsid Proteins

In various embodiments, the instant invention provides a fast, economical, sensitive and specific Topanga assay and Topanga reagents for detection of antibodies, antibody fragments, non-immunoglobulin antigen binding modules (e.g. Centyrins, affibody, DARPINS etc.) and SABR targeting the proteins (e.g. spike glycoprotein and nucleocapsid) encoded by SARS-cov2 that does not require any expensive equipment. Due to their extreme sensitivity and broad dynamic range, the assay and reagents can be used as a quality-control tool during the manufacturing of SARS-cov2-specific SABR-expressing cells and to monitor their persistence in the body after infusion. The Topanga assay and Topanga reagents based on the spike glycoprotein and nucleocapsid of SARS-cov2 can be also used to detect antibodies, antibody fragments and non-immunoglobulin antigen binding modules (e.g. Centyrins, affibody, DARPINS etc.) targeting these proteins.

Provided herein is a method for detecting expression of an antibody, antibody fragment, non-immunoglobulin antibody binding module or SABR targeting Spike glycoprotein of SARS-cov2, comprising: obtaining a sample in need determination of expression of the antibody, antibody fragment, non-immunoglobulin antibody binding module or SABR; optionally immobilizing the antibody, antibody, antibody fragment, non-immunoglobulin antibody binding module to a solid surface (e.g., protein G or anti-IgG or anti-IgM coated plate or beads), contacting the sample with a fusion protein comprising a reporter fused to the spike glycoprotein of SARS-cov2 or a fragment or variant thereof; washing the samples to remove any un-bound reporter-Spike glycoprotein fusion protein, and assaying the activity of the reporter; wherein presence of reporter activity or increase in reporter activity relative to a reference value is indicative of the expression of the antibody, antibody, antibody fragment, non-immunoglobulin antibody binding module, or SABR in the sample. In an embodiment, the Spike glycoprotein is represented by SEQ ID NO:701 or a variant thereof having at least 70% homology to the amino acid sequence of SEQ ID NO:701. In an embodiment, the fragment of the Spike glycoprotein comprises its receptor binding domain (SEQ ID NO: 700) or a variant thereof having at least 70% homology to the amino acid sequence of SEQ ID NO: 700. The antibody, antibody fragment or the non-immunoglobulin antibody binding module that bind to the S1-RBD (SEQ ID NO: 700) is likely to have neutralizing activity against SARS-cov2. In an embodiment, the fragment of spike glycoprotein comprises its N-terminal domains represented by SEQ ID NO: 707 and 712 or variant thereof having at least 70% homology to the amino acid sequence of SEQ ID NO: 707 and 712. In an embodiment, the fragment of spike glycoprotein comprises its C-terminal domain (S2 protein) represented by SEQ ID NO: 694 or a variant thereof having at least 70% homology to the amino acid sequence of SEQ ID NO: 694.

Also provided herein is a method for detecting expression of an antibody, antibody fragment, non-immunoglobulin antibody binding module or SABR targeting nucleocapsid protein (SEQ ID NO: 702) of SARS-cov2, comprising: obtaining a sample in need determination of expression of the antibody, antibody fragment, non-immunoglobulin antibody binding module or SABR; optionally immobilizing the antibody, antibody, antibody fragment, non-immunoglobulin antibody binding module to a solid surface (e.g., protein G or anti-IgG or anti-IgM coated plate or beads), contacting the sample with a fusion protein comprising a reporter fused to the nucleocapsid protein of SARSC-cov2 or a fragment or variant thereof; washing the samples to remove any un-bound reporter-nucleocapsid fusion protein, and assaying the activity of the reporter; wherein presence of reporter activity or increase in reporter activity relative to a reference value is indicative of the expression of the antibody, antibody, antibody fragment, non-immunoglobulin antibody binding module, or SABR in the sample. In an embodiment, the nucleocapsid protein is represented by SEQ ID NO:702 or variant or fragment thereof having at least 70% homology to the amino acid sequence of SEQ ID NO:702.

Also provided herein is a method for detecting expression of an antibody, antibody fragment, non-immunoglobulin antibody binding module or SABR targeting SARS-cov2 orf3a (SEQ ID NO: 720), comprising: obtaining a sample in need determination of expression of the antibody, antibody fragment, non-immunoglobulin antibody binding module or SABR; optionally immobilizing the antibody, antibody, antibody fragment, non-immunoglobulin antibody binding module to a solid surface (e.g., protein G or anti-IgG or anti-IgM coated plate or beads), contacting the sample with a fusion protein comprising a reporter fused to the orf3a of SARSC-cov2 or a fragment or variant thereof; washing the samples to remove any un-bound reporter-nucleocapsid fusion protein, and assaying the activity of the reporter; wherein presence of reporter activity or increase in reporter activity relative to a reference value is indicative of the expression of the antibody, antibody, antibody fragment, non-immunoglobulin antibody binding module, or SABR in the sample. In an embodiment, the orf3a is represented by SEQ ID NO:720 or variant or fragment thereof having 70% homology to the amino acid sequence of SEQ ID NO:720.

In an embodiment, the sample is a blood sample. In an embodiment, the sample is a serum sample. In an embodiment, the sample is a plasma sample.

In an embodiment, the sample is a fresh sample. In another embodiment, the sample is frozen prior to measurement of the antibody, antibody fragment or non-immunoglobulin antigen binding module.

In one embodiment, the reporter is a non-secretory form of a luciferase. In exemplary embodiments, the non-secretory form of luciferase is obtained from copepods, deep sea shrimp or homologs or orthologs thereof or mutants or derivatives thereof.

In some embodiments, the copepods are selected from the group consisting of any one or more of *Gaussia princeps, Pleuromamma abdominalis, Metridia pacifica, Metridia curticauda, Metridia asymmetrica, Metridia okhotensis, Metridia longa, Lucicutia ovaliformis, Heterorhabdus tanneri*, and *Pleuromamma scutullata.*

In some embodiments, the luciferase is any one or more of GLuc, NanoLuc (NLuc), MLuc7, HtLuc, LoLuc, PaLuc1, PaLuc2, MpLuc1, McLuc1, MaLuc1, MoLuc1, MoLuc2, MLuc39, PsLuc1, LocLuc1-3, HtLuc2 *Renilla*, TurboLuc16 (TLuc) or homologs or orthologs thereof or mutants or functional derivatives thereof.

In exemplary embodiments, the spike glycoprotein-reporter fusion proteins are represented by SEQ ID NO: 716-718, 1197-1199, 1215-1217, 1225-1227, 1232-1234, 1242-1244. These fusion protein constructs also carry a C-terminal puromycin resistance module that is separated from the spike-glycoprotein-reporter fusion module by a T2A cleavable linker. The puromycin resistance module is optional and is not needed for the activity of the reporter fusion protein.

In exemplary embodiments, the nucleocapsid-reporter fusion proteins are represented by SEQ ID NO: 719, 1211, 1228, 1245 and 1262. These fusion protein constructs also carry a C-terminal puromycin resistance module that is separated from the reporter fusion module by a T2A cleavable linker. The puromycin resistance module is optional and is not needed for the activity of the reporter fusion protein.

In exemplary embodiments, the orf3a-reporter fusion proteins are represented by SEQ ID NO: 1212, 1229, 1246, and 1263. The constructs also carry a puromycin resistance module that is optional and is not needed for the activity of the reporter fusion protein.

In some embodiments, the reporter activity is assayed by addition of a luciferase specific substrate. In one embodiment, the luciferase-specific substrate is coelentrazine or a derivative thereof. In another embodiment, the luciferase-specific substrate is imidazopyrazinone substrate (furimazine) or a derivative thereof.

In an embodiment, the sample is taken from a subject who is at risk of acquiring SARS-cov2 infection. In an embodiment, the sample is taken from a subject who is suspected of having SARS-cov2 infection. In an embodiment, the sample is taken from a subject to determine if the subject has history of having infected with SARS-cov2. In an embodiment, the sample is taken from a subject to determine if the subject is immune to SARS-cov2 infection.

In an embodiment, antibody against SARS-cov2 is IgM. In an embodiment, antibody against SARS-cov2 is IgG.

In some embodiments, the SABR is expressed on an immune cell. In one embodiment, the immune cell is a T cell. In another embodiment, the immune cell is a CD4 T cell. In a further embodiment, the immune cell is a CD8 T cell. In an embodiment, the immune cell is a Treg cell. In some embodiments, the immune cell is a naive T cell. In some embodiments, the immune cell is a memory T cell. In some embodiments, the immune cell is central memory T cell. In an embodiment, the immune cell is an effector memory T cell. In an embodiment, immune cell is an NK cell or an NK cell line (e.g., NK92 cell line or NK92MI cell line).

In some embodiments, the SABR is expressed on a stem cell. In an embodiment, the SABR is expressed on a hematopoietic stem cell. In an embodiment, the CAR is expressed on an induced pluripotent stem cell.

In some embodiments, the fusion protein further comprises a tag. In exemplary embodiments, the tag is any one or more of chitin binding protein (CBP), glutathione-S-transferase (GST), polyhistidine (His) tag, FLAG tag, HA tag, Myc tag, V5 tag, AcV5 tag, Streptag or a combination thereof.

In some embodiments, the reference value is the reporter activity in any one or more of (i) sample from a subject who has never been exposed to SARS-cov2; (ii) sample from the test subject where the sample is treated with an unrelated fusion protein; (iii) samples that are not treated with the substrate for the reporter; or (iv) combinations thereof.

In some embodiments, the reference value is the reporter activity in any one or more of (i) cells that do not express the SABR; (ii) cells that express the SABR but are treated with fusion protein which is not bound by the SABR; (iii) cells that are not treated with the substrate for the reporter; or (iv) combinations thereof.

In some embodiments, the reporter is fused to SARS-cov2 protein (e.g. S1, S2, S1-RBD, nucleocapsid, orf3a) through a covalent bond.

In some embodiments, the reporter is fused to the SARS-cov2 protein (e.g. S1, S2, S1-RBD, nucleocapsid, orf3a) through a non-covalent bond.

In some embodiments, the reporter is fused to the SARS-cov2 protein (e.g. S1, S2, S1-RBD, nucleocapsid, orf3a) through an intermediate molecule.

In some embodiments, a single molecule of the reporter is fused to the SARS-cov2 protein (e.g. S1, S2, S1-RBD, nucleocapsid, orf3a)

In some embodiments, more than one molecule of the reporter is fused to the SARS-cov2 protein (e.g. S1, S2, S1-RBD, nucleocapsid, orf3a).

In one embodiment, the assay is performed in vitro. In another embodiment, the assay is performed in vivo.

In various embodiments, luciferase activity described herein is measured by any one or more of methods for measuring light production such as a luminometer, X-ray films, microscopy, or combinations thereof. The nucleic acid and amino acid sequences of the fusion proteins described in the above section are presented in the corresponding sequence sections.

The host cell line utilized for expression of the Luc fusion proteins of the present invention can be of mammalian or non-mammalian origin. Those skilled in the art are credited with ability to preferentially determine particular host cell lines which are best suited for the desired gene product to be expressed therein. In one embodiment, the host cell line utilized for generation of the Luc fusion proteins of the invention is mammalian in origin. Exemplary host cell lines include, but are not limited to, DG44 and DUXBll (Chinese Hamster Ovary lines, DHFR minus), HELA (human cervical carcinoma), CVI (monkey kidney line), COS (a derivative of CVI with SV40 T antigen), R1610 (Chinese hamster fibroblast) BALBC/3T3 (mouse fibroblast), HAK (hamster kidney line), SP2/0 (mouse myeloma), P3×63-Ag3.653 (mouse myeloma), BFA-lclBPT (bovine endothelial cells), RAJI (human lymphocyte), 293FT and 293 (human kidney). Host cell lines are typically available from commercial services, the American Tissue Culture Collection or from published literature. In another embodiment, the host cell line utilized for generation of the Luc fusion proteins of the invention is of insect origin. In another embodiment, the host cells utilized for generation of the Luc fusion proteins of the invention are bacterial in origin. In another embodiment, the host cells utilized for generation of the Luc fusion proteins of the invention are of yeast origin. Those skilled in the art are credited with ability to preferentially determine particular promoters and vectors which are best suited for the expression of a desired gene product in a particular host cell line. Exemplary vector for expression of the Luc fusion protein of the invention is pLenti-EF1a (SEQ ID NO: 1) or pcDNA3 (SEQ ID NO: 17). Vectors for expression of proteins in other host cell lines are typically available from commercial sources, such as Thermofisher, Novagen and Sigma. In various embodiments, the fusion proteins described herein may be expressed in bacterial cells, yeasts or insects. The optimum vectors and promoters to be used for expression of the fusions proteins described herein and for the methods described herein will be apparent to a person of skill in the art.

In an embodiment, the fusion proteins are expressed in mammalian cells. In an embodiment, the fusion proteins are expressed in insect cells. In an embodiment, the fusion proteins are expressed in yeast cells. In an embodiment, the fusion proteins are expressed in bacterial cells. In an embodiment, the fusion proteins are expressed in vitro.

In an embodiment, the assay is conducted with the purified fusion protein. In an embodiment, the assay is conducted with unpurified fusion protein.

In an embodiment, the assay is performed as described in PCT/US2017/025602, which is incorporated herein in its entirety.

In an embodiment, the assay is conducted in tubes. In an embodiment, the assay is conducted in microwell plates. In an embodiment, the assay is conducted using Protein G, Protein A or Protein A/G coated plates or microbeads. In an embodiment, the assay is conducted using anti-IgG and anti-IgM coated plates or microbeads.

In an embodiment, the assay is carried out in 24 well plates, 48 well plates, 96 well plates or 384 well plates.

In an embodiment, the assay is used to measure the presence of antibodies to SARS-cov2 in a sample from a human subject. In an embodiment, the assay is used to measure the presence of antibodies to SARS-cov2 in a sample from an animal subject.

Malibu-Glo Reagents Against SARS-Co2

There are several methods currently in use for detection of SARS-cov2 antigens, including Flow cytometry, ELISA and western blotting. However, these methods require expensive equipment (such as flow cytometry), suffer from poor sensitivity and specificity (e.g., ELISA and Western blotting) or are time consuming. In various embodiments, the instant invention provides a fast, economical, sensitive and specific assay for detection of SARS-cov2 infected cells using a non-radioactive antigen detection assay described in PCT/US2017/025602, which is incorporated herein in its entirety.

Provided herein is a method for detecting the presence of SARS-cov2 spike glycoprotein in a sample, comprising: obtaining a sample infected with SARS-cov2; optionally immobilizing SARS-cov2 a to a solid surface, contacting the sample with a fusion protein comprising a reporter fused to moiety (e.g., scFv or vHH fragment etc.) capable of binding the spike glycoprotein of SARS-cov2; and assaying the activity of the reporter; wherein presence of reporter activity or increase in reporter activity relative to a reference value is indicative of the expression of the spike glycoprotein in the sample. The nucleic acid and amino acid SEQ ID of exemplary vL, vH and scFv fragments targeting the S1-RBD of SARS-cov2 are provided in Table 7A. The SEQ ID NO of the CDRs of the vL, vH fragments comprising the scFv are also provided in Table 7A.

Also provided herein is a method for detecting presence of SARS-cov2 in a sample, comprising: obtaining a sample in need determination of presence of SARS-cov2; optionally immobilizing SARS-cov2 to a solid surface, contacting the sample with a fusion protein comprising a reporter fused to the ACE2 extracellular domain (ECD) or a fragment or variant thereof; washing the samples to remove any unbound reporter-nucleocapsid fusion protein, and assaying the activity of the reporter; wherein presence of reporter activity or increase in reporter activity relative to a reference value is indicative of the presence of SARS-cov2 in the sample. In an embodiment, the ACE2-ECD is represented by SEQ ID NO:705 or variant or fragment thereof.

In one embodiment, the reporter is a non-secretory form of a luciferase. In exemplary embodiments, the non-secretory form of luciferase is obtained from copepods, deep sea shrimp or homologs or orthologs thereof or mutants or derivatives thereof.

In some embodiments, the copepods are selected from the group consisting of any one or more of *Gaussia princeps, Pleuromamma abdominalis, Metridia pacifica, Metridia curticauda, Metridia asymmetrica, Metridia okhotensis, Metridia longa, Lucicutia ovaliformis, Heterorhabdus tanneri,* and *Pleuromamma scutullata.*

In some embodiments, the luciferase is any one or more of GLuc, NanoLuc (NLuc), MLuc7, HtLuc, LoLuc, PaLuc1, PaLuc2, MpLuc1, McLuc1, MaLuc1, MoLuc1, MoLuc2, MLuc39, PsLuc1, LocLuc1-3, HtLuc2 *Renilla*, TurboLuc16 (TLuc) or homologs or orthologs thereof or mutants or functional derivatives thereof.

In an embodiment, the scFv reporter fusion protein targeting the spike glycoprotein of SARS-cov2 are represented by SEQ ID NO:1202-1204, 1218-1221, 1236-1238, 1253-1255 or variants or fragments thereof. These fusion protein constructs also carry a C-terminal puromycin resistance module that is separated from the reporter fusion module by a T2A cleavable linker. The puromycin resistance module is optional and is not needed for the activity of the reporter fusion protein.

In an embodiment, the ACE2-ECD reporter fusion protein is represented by SEQ ID NO:1213, 1230, 1247, 1264 or variants or fragments thereof. These fusion protein constructs also carry a C-terminal puromycin resistance module that is separated from the reporter fusion module by a T2A cleavable linker. The puromycin resistance module is optional and is not needed for the activity of the reporter fusion protein.

In some embodiments, the reporter activity is assayed by exposing the sample to a luciferase specific substrate. In one embodiment, the luciferase-specific substrate is coelentrazine or a derivative thereof. In another embodiment, the luciferase-specific substrate is imidazopyrazinone substrate (furimazine) or a derivative thereof.

In some embodiments, the fusion protein further comprises a tag. In exemplary embodiments, the tag is any one or more of chitin binding protein (CBP), glutathione-S-transferase (GST), polyhistidine (His) tag, FLAG tag, HA tag, Myc tag, V5 tag, AcV5 tag, Streptag or a combination thereof.

In some embodiments, the reference value is the reporter activity in any one or more of (i) sample (e.g., cells or serum) that does not express the SARS-cov2 spike glycoprotein; (ii) sample (e.g., cells or serum) that express the SARS-cov2 spike glycoprotein but are treated with fusion protein which does not bind to SARS-cov2 spike glycoprotein; (iii) cells that are not treated with the substrate for the reporter; or (iv) combinations thereof.

In some embodiments, the reporter is fused to the module (e.g., scFv or ACE2) targeting SARS-cov2 spike glycoprotein through a covalent bond.

In some embodiments, the reporter is fused to the module (e.g., scFv or ACE2) targeting SARS-cov2 spike glycoprotein through a non-covalent bond.

In some embodiments, the reporter is fused to the module (e.g., scFv or ACE2) targeting SARS-cov2 spike glycoprotein through an intermediate molecule.

In some embodiments, a single molecule of the reporter is fused to the module (e.g., scFv or ACE2) targeting SARS-cov2 spike glycoprotein.

In some embodiments, more than one molecules of the reporter are fused to the module (e.g., scFv or ACE2) targeting SARS-cov2 spike glycoprotein.

In an embodiment, the module (e.g., scFv or ACE2) targeting SARS-cov2 spike glycoprotein binds to its receptor binding domain.

In one embodiment, the assay is performed in vitro. In another embodiment, the assay is performed in vivo.

In an embodiment, the assay is performed as described in PCT/US2017/025602, which is incorporated herein in its entirety.

Also provided herein are kits for practicing the invention.

In another aspect, the invention relates to a kit comprising a pharmaceutical composition, cell or cell population, (such as T cells, NK cells, iPSC) comprising vectors encoding nucleic acids encoding SABR, wherein the antigen specific domain of the SABR targets spike glycoprotein of SARS-cov2.

EXAMPLES

The invention is further described in the non-limiting examples.

Generation of Lentiviral Vectors Encoding SABRs

The sequence of lentiviral vectors pLenti-EF1a or pLenti-EF1α and pLenti-EF1a-DWPRE is represented by SEQ ID NO: 1 and SEQ ID NO: 2. The sequence of pCCLc-MNDU3 Vector and its variants are provided in SEQ ID NO: 4-6. The generation of Chimeric antigen receptor (e.g., $2^{nd}$ generation CARs, SIRs, Ab-TCR and TFP etc.) the generation and use of GGS-NLuc fusion proteins, and the generation and use of luciferase (e.g., GLuc) reporter cell lines for measurement of cellular cytotoxicity using the Matador assays have been described (PCT/US2017/024843, PCT/US2017/025602, PCT/US2017/052344, PCT/US2017/064379 and PCT/US2018/53247), which are incorporated in their entirety by reference herein.

Example 1: Comparison of SABR Transduction of SARS-Cov2 CTLs Derived from PBMCs and Isolated T Cells PBMC are collected from a SARS-cov2 sero-positive donor who has been exposed to SARS-cov2 and recovered from infection as determined by seropositivity for SA cov2 spike glycoprotein or has received a SARS-cov2 vaccine. Optionally, the subject is administered between 1-3 booster doses of a SARS-cov2 vaccine between 1-31 days prior to collection of PBMCs. In another embodiment, PBMC are collected from a healthy donor who has not been exposed to SARS-cov2. PBMC are thawed and recovered into RPMI medium. Cells are split into two fractions; ⅓ of cells (Stimulators) are infected with the lentiviral vector pCCLc-MNDU3 (SEQ ID NO: 4) encoding Spike Glycoprotein, membrane glycoprotein, nucleocapsid phosphoprotein and orf3a of SARS-cov2 (nucleic acid SEQ ID NO:1047 and amino acid SEQ ID NO: 1167) by spin-infection. In alternate embodiments, stimulator cells are generated by infection with pCCLc-MNDU3 (SEQ ID NO: 4) encoding different proteins, peptides, polypeptides and polyepitopes of SARS-cov2 either alone, in various combinations or in fusion with Ub-G76A mutant. The nucleic acid sequences of exemplary SARS-cov2 proteins, peptides; polypeptides and polyepitopes are represented by SEQ ID NO:224-234 and 1047-1053 The corresponding amino acid sequences are represented by SEQ ID NO: 694-704 and 1167-1173, respectively. In an alternate embodiment, the stimulator cells are generated by infection with an adenoviral vector encoding Spike Glycoprotein, membrane glycoprotein, nucleocapsid phosphoprotein and orf3 a of SARS-cov2. In another alternate embodiment, the stimulator cells are generated by infection with a lentiviral or adenoviral vector encoding one or more of the SARS-cov2 proteins, peptides, polypeptides and polyepitopes in fusion with a drug inducible protein destabilization domain (DIPDD), such as FKBP12-F36V (SEQ ID NO: 1161), IKZF1-ZF2-145-167 (SEQ ID NO: 1162), IKZF1-ZF2-ZF3-145-197 (SEQ ID NO: 1163), IKZF1-ZF2-ZF3-145-243 (SEQ ID NO: 1164). The nucleic acid sequences of exemplary SARS-cov2 proteins, peptides, polypeptides and polyepitopes in fusion with the DIPDD are represented by SEQ ID NO:1054-1075. The corresponding amino acid sequences are represented by SEQ ID NO: 1174-1195.

Stimulators are then washed twice and resuspended in RPMI/AB serum culture medium and irradiated at 2500 cGy (2500 rads). The remaining ⅔ of cells (Responders) are either transferred to RPMI/AB serum medium and held at 37° C. until they are be mixed with the Stimulators or are used to isolate CD3$^+$ T cells that are then cultured with the Stimulator PBMC.

In an alternate embodiment, stimulator cells are expanded under conditions that favor the expansion of T cells. For this purpose, after infection stimulator cells are resuspended in fresh XVIVO media containing 10 ng/ml CD3 antibody, 10 ng/ml CD28 antibody and 100 IU recombinant human-IL2. The cells are expanded in GRex flasks for 7-14 days to allow the expansion of T cells. Subsequently, the stimulator cells are irradiated at 2500 cGy (2500 rads) and mixed with responder PBMC or CD3+ T cells.

PBMC Activation

On day 0, cultures are initiated in 6 well (10 cm$^2$) GRex culture plates at ratio of 9×10$^6$ irradiated Stimulator PBMC cells to 21×1.0$^7$ Responder PBMC cells and returned to 37° C., tissue culture incubation. Though optional, on days 9 and 10, cell cultures are depleted of CD56$^+$, NK (Natural Killer) cells, prior to transduction.

Activation of Isolated CD3$^+$T Cells

On day 0, T cells are isolated (i.e., enriched) from PBMC by means known in the art (e.g., live FACS or anti-CD3-coated magnetic beads). T cells are initiated in 6 well (10 cm$^2$) GRex culture plates containing media comprising 20 U/ml IL2, at a ratio of 1 T cell/4 Stimulator PBMC cells and returned to 37° C., tissue culture incubation. On days 9 and 10, cell cultures are transduced with the lentiviral vector to express SABRs (as above, NK cell depletion is optional prior to transduction). Sensitizing the starting material (e.g., following CD3$^+$ enrichment) to viral antigens, such as SARS-cov2, results in an increase in the percentage of central memory phenotype T cells in the resultant population.

SABR Transduction

On days 9 and 10 isolated T cell and PBMC cultures are transduced with recombinant lentivirus encoding anti-CD 19 SABR (and puromycin selection marker) using spin-infection as described previously. Briefly, lentivirus encoding anti-CD 19 SABR are thawed at room temperature and added to plates in the presence of polybrene. Plates are wrapped in paraffin film and centrifuged at 2000×g for 2 hours at 32° C. Viral supernatant is aspirated and 1 ml of prepared cell suspension from each stimulation group (0.5× 10$^6$ cells/mL resuspended in YH5 media) is added. Plates are centrifuged at 1000×g for 15 minutes at 32° C. and incubated at 37° C., 5% CO2 overnight.

Cells for each stimulation condition are then removed and pooled for counting. Cells are resuspended in fresh YH5 media at 0.5-1.0×10$^6$ cells/ml.

On day 11, each stimulation condition (i.e. of isolated T cells or of Responder PBMC) are returned to culture with irradiated Stimulator PBMC. Samples are taken at each of Days 15, 23 and 27 for Fluorescence-Activated Cell Sorting (FACS) (e.g., for CD3$^+$, scFV$^+$ cells). Drug selection (puromycin) is induced on day 19.

SARS-cov2-CTLs derived from isolated T cells demonstrate improved viability and proliferative capacity. CD3$^+$ enriched starting material has a greater yield over conventional expansion and transduction conditions, demonstrating significantly improved viability and proliferative capacity. The efficiency of downstream SABR vector transduction is dependent upon proliferative capacity. Thus, higher viability and proliferative capacity in the antigen-stimulated T cells results in improved downstream SABR transduction efficiency. When compared to transduction in a crude PBMC culture, SABR SARS-cov2 CTLs derived from an initial CD3$^+$ enrichment step demonstrate a significant enhancement of downstream SABR transduction efficiency post stimulation and also show greater cell viability in response to puromycin selection.

Example 3: Generation of Anti-CD 19-SABR CTL Following Stimulation with PBMC or K562 Cells Expressing One or More of SARS-Cov2 Structural Proteins (e.g., Spike Glycoprotein, Nucleocapsid Phosphoprotein or Membrane Glycoprotein)

Standard anti-CD3/CD28 bead-based stimulation is widely used in the field as a method to expand T cells in vitro prior to transduction with SABR vectors. The following experiment is undertaken to determine the impact of various SABR-T cell stimuli amenable to a high-yield manufacturing process on the memory T cell immune-phenotype for a final therapeutic product.

K562 cells are infected with pCCLc-MNDU3 (SEQ NO: 4) encoding different proteins, peptides, polypeptides and polyepitopes of SARS-cov2 either alone, in various combinations or in fusion with Ub-G76A mutant. The nucleic acid sequences of SARS-cov2 proteins, peptides, polypeptides and polyepitopes are represented by SEQ ID NO:224-234 and 1047-1053. The corresponding amino acid sequences are represented by SEQ ID NO: 694-704 and 1167-1173, respectively. In another alternate embodiment, the stimulator cells are generated by infection with a lentiviral or adenoviral vector encoding one or more of the SARS-cov2 proteins, peptides, polypeptides and polyepitopes in fusion with a drug inducible protein destabilization domain (DIPDD), such as FKBP12-F36V (SEQ ID NO: 1161), IKZF1-ZF2-145-167 (SEQ ID NO: 1162), IKZF1-ZF2-ZF3-145-197 (SEQ ID NO: 1163), IKZF1-ZF2-ZF3-145-243 (SEQ ID NO: 1164). The nucleic acid sequences of exemplary SARS-cov2 proteins, peptides, polypeptides and polyepitopes in fusion with the DIPDD are represented by SEQ ID NO:1054-1075. The corresponding amino acid sequences are represented by SEQ ID NO: 1174-1195. K562 cells are expanded under standard conditions. K562 cells infected with vectors encoding SARS-cov2 proteins, peptides, polypeptides and polyepitopes in fusion with FKBP12-F36V are cultured in the presence of dTAG13 to induce degradation of the fusion protein. K562 cells infected with vectors encoding SARS-cov2 proteins, peptides, polypeptides and polyepitopes in fusion with IKZF1-ZF2-145-167, IKZF1-ZF2-ZF3-145-197, IKZF1-ZF2-ZF3-145-243 are cultured in the presence of Pomalidomide (2-10 µM), lenalidomide (5-10 µM), CC220 (2-5 µM), or CC885 to induce degradation of the fusion proteins.

The K562 cells optionally can be engineered to express one or more costimulatory molecules, such as 41BBL, CD80, CD83, CD86 and/or vFLIP K13.

The resulting K562 cells are irradiated at 90 Gy (9000 rads) and serve as Stimulator cells as described in the preceding example.

Isolated CD3$^+$, SARS-cov2-antigen specific T cells are stimulated and expanded with no stimulation, stimulation with soluble anti-CD3/CD28, stimulation with anti-CD3/CD28 beads, stimulation with K562 cells expressing SEQ ID NO: 1167-1173; stimulation with K562 cells expressing SEQ ID NO: 1186-1190 in the presence of dTAG13; stimulation with K562 cells expressing SEQ ID NO: 1191-1195 in the presence of pomalidomide (2 µM); stimulation with PBMC expressing SEQ ID NO: 1167-1173; stimulation with PBMC expressing SEQ ID NO: 1186-1190 in the presence of dTAG13; stimulation with PBMC expressing SEQ ID NO: 1191-1195 in the presence of pomalidomide (2 µM).

Following 3 days of stimulation, each culture is transduced with a viral vector encoding a synthetic antigen binding receptor (SABR) and returned to incubation for 7 days in standard (YE media) culture to allow for expansion of the transduced T cells. Cells are then harvested and cell phenotypes analyzed by cell staining and fluorescence activated cell sorting.

CD3$^+$, SARS-cov2-antigen specific T cells are removed from liquid nitrogen storage, thawed, and suspended in YH media at a concentration of $2\times10^6$ cells/mL with 100 IU/mL IL-2. The suspension is plated in a 24-well plate with 2 mLs of the suspension per well and incubated overnight. Following this overnight recovery, cells are counted and divided into the nine different treatment groups as described above with $6\times10^6$ cells per group, at a concentration of $1\times10^6$ cells/mL.

Stimulation with anti-CD3/CD28 Dynabeads is done at a cell:bead ratio of 1:1. A sufficient volume of beads is removed and washed in DPBS prior to direct addition to the cell suspension. Accordingly, stimulation culture is plated at 2 mL YH5 media with 100 IU/mL IL-2 per well in a 24 well plate, as above, and incubated for 3 days.

Stimulation with soluble anti-CD3/CD28 is done by direct addition of CD3/CD28 ImmunoCult™ reagent at a concentration of 25 µl per mL and incubated for 3 days.

Stimulation with SARS-cov2 expressing PBMC is done at a ratio of 1 SARS-cov2 antigen-specific T cell to four PBMC. Briefly, CD3+, SARS-cov2-antigen specific T cells are removed from liquid nitrogen storage, thawed, suspended in YH media, and allowed to recover. In preparation for stimulation culture, SARS-cov2-expressing K562 cells are irradiated with a total dose of 90 Gy (9000 rads) of radiation. SARS-cov2-K562 and antigen-specific cells are combined in YH5 media with 100 IU/mL IL-2 in the same 24-well plate as above and incubated for 3 days.

Lentiviral vector encoding the SABR (comprising either a 4-1BB or CD28 signal transduction domain) are used to infect the T cells by spin-infection as described.

Cells from each stimulation group are pooled, counted, and resuspended at a concentration of $0.5-1.0\times10^6$ cells/mL of fresh YH5 media before returning to incubation at 37° C., 5% CO2 for 2 days. Pooling and resuspension is repeated every two days until the seventh day (harvest). Once harvested cells are labeled and a flow cytometry gating strategy is applied to identify CD3, CD4, CD8, CD62L and CD45RO on the SABR-expressing T cells. Briefly, cell signals of interest are first identified by size and granularity (i.e. forward scatter (FSC) vs. side scatter (SSC)). Living cells are then identified based on staining with a viability dye (e.g., Live/Dead™ BV510). Viable single cells are then gated based on pulse-area vs. pulse-height (FSC-A vs. FSC-H). Individual CD3$^+$ T cells and subsequent subpopulations (e.g. CD4$^+$, CD8$^+$, central memory T cells) can then be identified using fluorescently-labeled antibodies.

Flow cytometric evaluation indicates that transduced CD 19-SABR-T cells stimulated with SARS-cov2-K562 or PBMC showed higher percentages of central memory T cell subsets as evaluated by CD62L$^+$/CD45RO$^+$ cells compared to soluble CD3/CD28 or bead stimulation.

These data demonstrate that stimulation of SABR-T cell cultures with BLCLs expressing SABR-targeted antigens leads to a shift to predominant central memory phenotype when compared to results from CD3/CD28 stimulation through bead-bound or soluble antibodies. This study supports the potential for improved quality of SABR-T cell cultures that utilize antigen-positive APC stimulation (as represented by antigen-presenting K562 or PBMC) versus the quality expected when using standard anti-CD3/CD28 bead or other acellular modes of stimulation.

Example 4: Anti-CD19-SABR-SARS-Cov2-CTLs Exert Potent and Specific Cytotoxicity

Similarly as above, lentiviral vector encoding the SABR (comprising either a 4-1BB or CD28 signal transduction domain) is used for transduction of SARS-cov2-BLCL-stimulated, CD3$^+$, antigen-specific T cells.

Briefly, SABR-expressing, virus-specific T cells are prepared in the following manner.
  Day 0, PBMC samples are thawed, and CD3$^+$ cells are enriched (e.g., by live FACS or anti-CD3-coated magnetic beads). These CD3$^+$ T cells are then stimulated by culturing with SARS-cov2-antigen-presenting BLCLs, K5462 or T cells as described herein.
  11 days post-stimulation (on Day 11), the culture are depleted of NK cells (e.g., using anti-CD56 beads) and re-stimulated with fresh SARS-cov2-antigen-presenting BLCLs, K5462 or T cells at a responder/stimulator ratio of 1:4 for 7 days.
  On Day 18, the culture are stimulated, at a responder/stimulator ratio of 4:1 for 2 days.
  On Day 20 transduction is initiated on with a viral vector encoding a synthetic antigen binding receptor (SABR) and returned to incubation in standard (YET media) culture to allow for expansion of the transduced, virus-specific T cells. Optionally, an NK cell depletion step may be employed immediately prior to transduction.
  By Day 25, SABR-expression is assessed (e.g., by FACS analysis) and SABR-expressing, virus-specific T cells (effectors) are be added to target cultures for cytotoxicity assays.

Cytotoxicity, measured by Matador assay, is observed after 4 hours in co culture with SARS-cov2-SABR19-SABR T cells or control SARS-cov2 CTLs at the ratios of 5:1. SARS-cov2-CD19-SABR T cells demonstrate HLA-independent, CD19-specific cytotoxicity with low allo-cytotoxicity as observed by the specific killing of CD19$^+$ (NALM6 and Raji) cells and SARS-cov2$^+$/CD19$^+$ HLA-matched and mismatched. BLCLs. In contrast, K562 cells, and HLA-matched and mismatched PHA blasts, all of which lack SARS-cov2 and CD19 antigen, are not killed. Moreover, SARS-cov2-sensitized, anti-CD 19 SABR T cells are cytotoxic to all CD19$^+$ cell lines with less off-target cytotoxicity, i.e., less or non-existent cytotoxicity to cells lacking both CD19 and SARS-cov2 expression. When observed for three days following effector addition (i.e., SARS-cov2-CTL or SARS-cov2-CD19 SABR T cell addition) specific and potent HLA-independent cytolysis is observed in targeted cells. Cytolysis is induced in both HLA-matched (BLCL targets) and HLA-mismatched (BLCL and Raji targets) cells. However, SARS-cov2-CTL are shown to only induce significant cytolysis in matched BLCL target cells.

When compared to conventionally produced SABR T cells (i.e., without enrichment or antigen stimulation of starting T cultures), antigen-specific SABR T cells (e.g., anti-CD19-CD28-SABR-SARS-cov2-CTLs) exhibit comparable, if not better, cytotoxicity. However, anti-CD 19-CD28-SABR-SARS-cov2-CTLs appear to be less alloreactive. The proliferative capacity of SARS-cov2-specific CD 19-SABR T cells is observed by CellTrace™ Violet dilution assays upon co-culture with the indicated cell lines. Anti-CD19-CD28-SABR-SARS-cov2-CTLs retain the ability to kill B-lymphoblastoid cell lines (BLCL) but spared autologous and allogeneic PHA-blast targets lacking CD 19 and SARS-cov2 antigen expression with notably less alloreactivity relative to conventional SABR T cells.

Example 5: Use of Allogeneic SABR-Expressing SARS-Cov2 Specific T Cells for Adoptive Cells Therapy Patients with relapsed Acute Lymphocytic Leukemia or high-risk intermediate grade B-cell lymphomas may receive immunotherapy with adoptively transferred HLA-matched allogeneic SABR-T cells. A leukapheresis product is collected from a SARS-cov2 seropositive allogeneic donor and used to isolate PBMC by Ficoll-Hypaque separation. A high-resolution HLA typing is done on the donor PBMC. Optionally, CD3 positive T lymphocytes are selected using the CliniMACS Prodigy® System from Miltenyi Biotec and following the manufacturer's recommendations. One third of the T cells are used to generate Stimulator cells, while the remainder are used as responder cells. Optionally, the expression of β2M and CD52 is eliminated in T cells by CRISPS mediated knock-out using techniques known in the art and T cells lacking cell surface expression of HLA and/or CD52 are selected. PBMC and/or T cells are transduced with a lentiviral vectors encoding SARS-cov2 encoded peptides, polypeptides, proteins and polyepitopes (SEQ ID NO: 1047-1053) to serve as Stimulator cells. Alternatively, JEKO-1 cells expressing the SARS-cov2 encoded peptides, polypeptides, proteins and polyepitopes (SEQ ID NO: 1047-1053) and co-expressing 41BBL, CD80, CD83, CD86 and vFLIP K13 serve as Stimulator cells. Responder T cells are expanded by co-cultured with Stimulator cells at ratio of 1:4 in XVIVO medium with 20 IU/ml of IL2 in a GRex culture flask for 2-7 days to generate SARS-cov2 specific CTLs. The SARS-cov2 specific CTLs are transduced with a clinical grade CD19-SABR virus (e.g., CD8SP-hu-mROO5-1-vL-[hTCRb-S57C]-F-P2A-SP-hu-mROO5-1-vH-[hTCRa-T48C](SEQ ID NO: 261). After viral transduction, SARS-cov2 specific CTLs expressing CD19 SABR are expanded for 9-12 days in the presence of irradiated Stimulator JEKO-1 cells or BLCLs in a GRex flask at a ratio of 1:4. After the resulting cell product has undergone quality control testing (including sterility and tumor specific cytotoxicity tests), they are cryopreserved in aliquotes. A patient with refractory B-All, is enrolled in a trial to receive the allogeneic SARS-cov2 specific CTLs expressing CD19 SABR. The patient is a full HLA match (12/12) with the donor. The patient receives lymphodepletive chemotherapy (30 mg/m$^2$/day fludarabine plus 500 mg/m$^2$/day cyclophosphamide×3 days). The patient may optionally receive a single dose of a CD52 antibody (e.g., alemtuzumab at 0.1 to 0.5 mg/kg) between 5-15 days prior to infusion of T cells. One day after completion of the lymphodepleting regimen, the patient receives allogeneic SARS-cov2 specific CTLs expressing CD19 SABR intravenously. The dose of SABR-T product may vary from 1×10$^4$ SABR+ve CD3 cells/kg to 5×10$^9$ SABR+ve CD3 cells/kg as per the study protocol. The SABR product may be administered in a single infusion or split infusions. Use of immunosuppressive drugs is at the discretion of the physician. Essentially a similar approach can be used to treat other diseases using allogeneic SARS-cov2 specific CTLs (e.g., T cells) expressing the SABR of the disclosure where the SABR targets an antigen or antigens expressed on the disease causing or disease-associated cells.

Example

SARS-CoV-2-specific T cells were generated from PBMCs isolated from a healthy donor fully vaccinated with SARS-CoV2 Pfizer vaccine. PBMCs were pulsed with PepTivator SARS-CoV2-Prot_S (Cat #130-126-700; Miltenyi Biotec), a pool of lyophilized peptides, consisting of 15-mer sequences with 11 amino acids (aa) overlap, covering the immunodominant sequence domains of the surface glycoprotein (S) of SARS-CoV2. The PepTivator SARS-CoV-2 Prot_S contains the sequence domains aa 304-338, 421-475, 492-519, 683-707, 741-770, 785-802, and 885-1273. This mix of overlapping peptide pool was used at a concentration of 1 µg/µL per $15 \times 10^6$ PBMCs for 30 minutes at 37° C. After incubation, cells were resuspended with 400 IU/mL interleukin-4 (R&D Systems) and 10 ng/mL IL-7 (Peprotech) in CTL media consisting of 45% RPMI, 45% Click medium (Irvine Scientific), and 10% fetal bovine serum (FBS) and plated in a 6-well GRex plate for expansion. Cytokines and peptide pulsed PBMC were replenished on day 7. On day 10, cells were harvested and evaluated for antigen specificity and functionality using a SARS-CoV-2 Prot_S T cell analysis kit (Cat #130-127-586; Miltenyi Biotec).

Expansion is continued as above for 2-3 weeks. After expansion, the SARS-CoV-2 specific T cells are isolated and used to generate SABR-T cells by infection with a lentiviral vector encoding a SABR against CD19. The SABR-T cells generated from SARS-CoV2 specific T cells are found to be less alloreactive in a mixed lymphocytic reaction and cause less Graft vs host disease when tested in immunodeficient mice as compared to the SABR-T cells generated from parental T cells that have not been enriched for SARS-CoV2 specificity.

Example 6: Development of Topanga, a Novel Luciferase-Based Assay for Detection of SARS-Cov2 SABR A challenge in the field of cellular immunotherapy is the lack of a robust assay for detection of SABR on the surface of immune cells. We recently described a fast, economical, sensitive and specific assay for detection of SABRs on the surface of immune cells (6). The method consists of fusing the antigen binding domain to a marine luciferase. The expression cassette also carries sequences encoding single or multiple copies of epitope tags, such as FLAG, HA and MYC, Streptag and polyhistidine tag. To demonstrate the feasibility of the assay, we expressed a second generation CAR (SEQ ID NO: 309) directed against the S-RBD of SARS-cov2 in JNG cells, which is a clone of Jurkat T cells that has been engineered to express GFP under an NFAT promoter. S-RBD-NLuc (SEQ ID NO: 717) and PSMA-NLuc (negative control) fusion proteins were generated by transient transfection of 293FT cells with the corresponding expression vectors. The expression cassette for S-RBD-NLuc (SEQ ID NO: 247) also contained a Puromycin resistance gene, which was separated from the S-RBD-NLuc cassette by a T2A cleavable linker. Supernatants containing the secreted fusion proteins were collected 24-72 h after transfection. JNG-parental (JNG-P) and JNG-S-RBD-BBz CAR cells were incubated with S-RBD-NLuc and PSMA-NLuc (negative control) fusion proteins, followed by extensive washes and measurement of the bound fusion protein by luciferase reporter assay. A nearly 20-fold increase in luciferase activity was observed upon binding of S-RBD-NLuc to JNG-S-RBD-BBz CAR cells as compared to the JNG-P cells, demonstrating the remarkable sensitivity and specificity of the assay. Essentially similar results were obtained when the NLuc was replaced by GLuc, TLuc or MLuc7 in the S1-RBD fusion-reporter protein. The nucleic acid sequences of S1-RBD in fusion with the GLuc, TLuc and MLuc7 are represented by SEQ ID NO: 1106, 1123 and 1141, respectively. The corresponding amino acid sequences are represented by SEQ ID NO:1226, 1243 and 1260, respectively.

To demonstrate the feasibility of Topanga assay, we performed a pilot experiment using SARS-CoV2-monoclonal antibody CR3022 that binds to SARS-CoV2 RBD. Serial dilutions of CR3022 (BEI resources) were added to individual wells of a Protein G coated 96 well plate in duplicate. After incubation, wells were washed and 100 µl of S1-RBD-NLuc supernatant was added to each well for 1 h. After washes, luminescence was read by addition of coelenterazine. An increase in luminescence above the PBS control was visible even at the lowest concentration of CR3022 tested (i.e., 0.1 pg/ml), thereby demonstrating the extreme sensitivity of the assay. There was a linear decrease in luminescence with increased dilution of CR3022 ($R2=1$).

Serum samples from COVID-19 (+) patients and a normal control were obtained. Serial dilutions of samples were tested using S1-RBD-NLuc supernatant and using Protein G coated 384 well plate. A difference between positive and negative samples was noted even at the lowest dilution (1:1000) tested. To demonstrate the specificity of the assay, 14 serum samples from COVID(−) subjects were examined and were found to be negative.

Topanga-reagent based on SARS-CoV2 RBD was purified using Streptacin Resin and demonstrated functional activity against sero-positive and sero-negative samples. Crude supernatant of Topanga Reagents offered equal sensitivity and specificity as the purified protein. Crude and purified Topanga reagents also demonstrated increase in immune response to SARS-CoV2 vaccine. A nearly 2 fold increase in titers were observed after the first dose of Pfizer vaccine and a nearly 10 fold increase in titer was observed after the $2^{nd}$ dose of Pfizer vaccine. Essentially similar results are obtained when experiment is repeated using vaccines from other manufacturer (e.g., Moderna, Johnson and Johnson, Astrazaneca, Sinovac etc.)

Next Topanga reagents were generated using S1-RBD derived from different variants of SARS-CoV2 containing mutations L452R, L477N, E484K, K417N, K417N-E484K-N501Y etc. The Topanga reagents based on variants were used to monitor immune response the subject vaccinated using the SARS-Cov2 vaccines from Pfizer. It was observed that the variant Topanga reagents can inform the residual immunity present against the variant in the post-vaccination sample and inform the decision to receive a booster dose depending on whether the level of antibodies have fallen below the pre-vaccination level or the level of antibodies in the control serum.

Example 7: Development of Malibu-Glo Antigen Detection Assay

The antigen binding portion of CARs is generally composed of scFv derived from antibodies. To rapidly screen the different scFv fragments and other antigen binding motifs (e.g., vHH, centyrins etc.) for optimal antigen binding affinity, we recently described another novel assay called the Malibu-Glo assay. In contrast to the Topanga reagent, the Malibu-Glo reagent involves fusion of an antigen binding motif (e.g., a scFv fragments) to a cassette encoding a marine luciferase (e.g., NLuc) and different epitope tags. To demonstrate the feasibility of the Malibu-Glo assay, we stably expressed the receptor binding domain of Spike glycoprotein (S-RBD) of SARS-cov2 in K562 cells in a membrane anchored manner by fusion to the hinge and transmembrane domains of murine CD8 and generated two mass populations, K562-S-RBD #1 and K562-S-RBD #2, respectively. The nucleic acid and amino acid sequences of the construct are represented by SEQ ID NO: 229 and 699, respectively. We also generated a lentiviral expression vector encoding the Malibu-Glo reagent CD8SP-SARScov2-CR3022-(vL-vH)-GGSG-NLuc-4×FLAG-×2STREP-8× His-T2A-PAC (SEQ ID NO:1082). In this vector the scFv targeting the S1-RBD is fused to a cassette encoding NLuc-4×FLAG-×2STREP-8×His via a GGSG linker. The cassette is linked via a T2A cleavable linker to a puromycin resistance gene (PAC). We expressed the fusion protein by transient transfection in 293FT cells and collected the secreted fusion protein (SEQ ID NO: 1219) in the supernatant approximately 72 h post-transfection. K562-parental (K562-P), K562-S-RBD #1 and K562-S-RBD #2 cells were incubated with the secreted fusion protein (SARScov2-CR3022-(vL-vH)-GGSG-NLuc). A PSMA-GGS-NLuc fusion protein was used as negative control. Following extensive washes, the cell bound scFv was measured by addition of coelentrazine and measurement of light production. A marked increase in luciferase activity was observed upon binding of SARScov2-CR3022-(vL-vH)-GGSG-NLuc (S-RBD-scFv-NLuc) fusion protein to K562-S-RBD #1and K562-S-RBD #2 cells as compared to the K562-P cells. In contrast, negligible binding of PSMA-GGS-NLuc fusion protein was observed to K562-P or K562-S-RBD #1 or #2 cells. These results demonstrate the remarkable sensitivity and specificity of the Malibu-Glo assay for selection of an optimal scFv for incorporation into a CAR. The results further demonstrate that the candidate scFv chosen by us can specifically recognize and bind with good affinity to the receptor binding domain of the spike glycoprotein (S-RBD) of SARS-cov2. Essentially similar results were obtained when the NLuc module was replaced by GLuc, TLuc and MLuc7. The nucleic acid sequences of SARScov2-CR3022-(vL-vH) in fusion with the GLuc, TLuc and MLuc7 are represented by SEQ ID NO: 1099, 1116 and 1133, respectively. The corresponding amino acid sequences are represented by SEQ ID NO:1219, 1236 and 1253, respectively. Finally, essentially similar results are obtained when the SARScov2-CR3022-(vL-vH) is replaced by SARS-cov2-S-RBD-H4-(vL-vH) and SARScov2-S-RBD-B38-(vL-vH).

Example 8: Generation and Activity of SABR Against SARS-Cov2 Spike Glycoprotein

Based on the results showing the specific binding and high affinity of the scFv SARScov2-CR3022-(vL-vH) against S-RBD, we next incorporated this scFv into a lentiviral vector to generate a second-generation S-RBD-specific CAR containing a 41BB costimulatory domain (S-RBD-BBZ-CAR) (SEQ ID NO: 309). We also generated a SABR on the SIR background incorporating the vL and vH fragment from this scFv. The nucleic acid and amino acid sequence of this SIR are represented by SEQ ID NO: 318 and 788, respectively. We expressed these SABR (CAR and SIR) constructs into JNG cells (Jurkat-NFAT-GFP) cells that express GFP under an NFAT promoter as described above. To test the ability of the SABR to induce T cell signaling in an antigen-specific manner, we co-cultured the JNG-P and JNG-S-RBD-BBz CAR and JNG-S-RBD-002-SIR cells with K562-parental (K562-P) and K562-S-RBD and RAJI-parental (RAJI-P) and RAJI-S-RBD cells. Induction of NFAT-signaling driven GFP expression was measured after overnight co-culture using flow-cytometry. Co-culture of JNG-S-RBD-BBz CAR and JNG-S-RBD-002-SIR cells with K562-S-RBD and RAJI-S-RBD cells led to increase in GFP induction as compared to incubation with K562-P and RAJI-P cells. These results demonstrate that S-RBD-specific CAR and SIR can specifically recognize and induce T cell signaling upon encountering target cells expressing cell surface expressed RBD of spike glycoprotein of SARS-cov2. In alternate embodiment, the experiment is repeated with other SABRs targeting SARS-cov2 spike glycoprotein RBD as listed in Table 9-11.

The SABR targeting SARS-cov2 S1-RBD are expressed in primary T cells using lentiviral mediated gene transfer. The T cells are expanded and co-cultured with K562-S-RBD and RAJI-S-RBD cells stably expressing GLuc for 24-48 hours. Effective lysis of the target cells is observed using the Matador assay. Further, increased secretion of IFNγ and TNFα is observed in the supernatant of SABR-T cells when cultured with K562-S-RBD and RAJI-S-RBD cells as compared to K562-P and RAJI-P cells. The experiment is also repeated with other SABRs targeting SARS-cov2 spike glycoprotein RBD as listed in Table 9-11.

The SABR targeting SARS-cov2 S1-RBD are also expressed in primary T cells obtained from an allogeneic donor using lentiviral mediated gene transfer. The TRAC and beta2 microglobulin (B2M) genes are deleted in the donor cells using CRISP/Cas9. The allogeneic T cells are expanded and co-cultured with K562-S-RBD and RAJI-S-RBD cells stably expressing GLuc for 24-48 hours. Effective lysis of the target cells is observed using the Matador assay. Further, increased secretion of IFNγ and TNFα is observed in the supernatant of SABR-T cells when cultured with K562-S-RBD and RAJI-S-RBD cells as compared to K562-P and RAJI-P cells. The allogeneic SABR-T cells targeting S-RBD of spike glyoprotein of SARS-cov2 are also administered to a patient with COVID-19. The experiment is also repeated with other SABRs targeting SARS-cov2 spike glycoprotein RBD as listed in Table 9-11.

The SABR targeting SARS-cov2 S1-RBD are also expressed in NK92MI cell line. The cells are expanded under cGMP conditions, tested for potency using the Matador assay and administered to a patient with COVID-19 in escalating doses.

The SABR targeting SARS-cov2 S1-RBD are expressed in human iPSC cells. The endogenous TRAC and B2M genes are deleted in the iPSC cells. The cells are expanded under cGMP conditions and differentiated into NK and T cells in vitro. The cells are tested for potency using the Matador assay and administered to a patient with COVID-19 in escalating doses.

Example 9: Use of Matador Assay to Test for Presence of SARS-Cov2 and Related Coronaviruses VeroE6 cells are engineered to stably express TMPRSS2 (SEQ ID NO: 236). VERO-E6 and VERO-E6-TMPRSS2 cells are further engineered to stably express Glue, NLuc, TLuc, MLuc7 or LucPPe-146-1H2 (SEQ ID NO: 21) in intracelluarly. The SEQ ID of the luciferases are provided in Table 2. To test the presence of SARS-cov2 in a sample, serial dilution of samples are added to VERO-E6 or VERO-E6-TMPRSS2 cells that have been plated the day before in a 96 well plate to result in 50% confluency. After varying period of time, supernatant is collected and used for the measurement of luciferase activity by addition of appropriate substrate (e.g., coelentrazine or D-luciferin). In an alternate embodiment, the luciferase activity is directly measured by adding the substrate to the 96 well plate as described previously. Cells treated with serial dilution of a known sample of SARS-cov2 serve as positive control, whereas cell treated with phosphate buffer saline serve as negative control. The increase in luciferase activity in sample treated with the virus as compared to control is reflective of the presence of the virus in the preparation. The titer of the virus is measured by comparison to the increase in luciferase activity with serially diluted samples of positive control.

The above assay is also modified to detect and measure the presence of an inhibitor of SARS-cov2 infectivity. For example, cells are treated with a known dose of SARS-cov2 in the presence of increasing concentration of a neutralizing antibody to SARS-cov2. The presence of neutralizing antibody and/or its activity is measured by measuring the luciferase activity in the cell supernatant or in cell population upon the addition of the appropriate substrate.

In an alternate embodiment, a dual reporter cell line is engineered that stably expresses intracellularly a marine luciferase (e.g., Gluc, TLuc, NLuc, MLuc7 etc.) and LucPPe-146-1H2 or its variants. After treatment with a preparation containing SARS-cov2, the LucPPe-146-1H2 and GLuc activities are sequentially measured from the sample using the Dual-Luciferase® Reporter (DLR™) Assay System (Promega) and following the manufacturer's recommendations.

Example 10: Development of Matador Assay to Measure the Cytotoxicity of Cellular and Immunotherapeutics Targeting SARS-Cov2 and Related Coronaviruses K562 and RAJI cells are engineered to stably express Glue, NLuc, MLuc7 or LucPPe-146-1H2 (SEQ ID NO: 21) intracelluarly. The cells are subsequently engineered to express one or more of SARS-cov2 encoded proteins, peptides, polypeptides and polyepitopes as described previously. In an exemplary embodiment, K562-S-RBD and RAJI-S1-RBD cells are engineered to express Glue intracellularly. To measure the cytotoxicity of a SABR-T cell targeting S-RBD of SARS-cov2, the K562-S-RBD-Glue cells are co-cultured with T cells encoding the SABR (S-RBD-BBZ-CAR) (SEQ ID NO: 309) at an effector to target (E:T) ratio of 1:1, 5:1 and 10:1 for 24 hours in a 384 well plate. The cytotoxicity of SABR-T cells is measured by addition of coelentrazine to the plates using an autoinjector as described previously.

In alternate embodiment, any suitable cell line expressing a heat stable luciferase and one or more of the SARS-cov2 encoded proteins, peptides, polypeptides and polyepitopes can be used in the Matador assay for measuring the cytotoxicity of an agent targeting SARS-cov2.

Example 11: Development of Topanga Assay for Detection of SARS-Cov2 Antibodies

Expression cassettes encoding Topanga reagents comprising different protein encoded by SARS-cov2 in fusion with marine luciferases are represented by SEQ ID NO:1197-1200, 1208-1212, 1215-1217, 1225-1229, 1232-1234, 1242-1246, 1249-1251 and 1259-1263. The fusion constructs are transfected in 293FT cells and fusion proteins purified from the cell supernatant (in case of secreted proteins) and cytosol (in case of non-secreted proteins) using StrepTactin column. 96-well Costar flat-bottomed luminometry plates are coated with protein G (5 µg/mL, 100 µL/well) in carbonate buffer (pH 9.6) overnight at 4° C. After three washes with phosphate buffered saline (PBS) containing 0.05% Tween 20 (PBS-T), the plates are incubated with blocking solution (PBS containing 5% non-fat milk) for 1 h at 37° C. Then the wells are washed, and aliquots of serially diluted sera (100 µL) are added to the wells and incubated for 1 h at 37° C. The plates are washed and incubated with 50 µl of diluted Nluc fusion proteins (10-100 ng) for 30 min at 37° C. Then the plates are washed again, and luciferase activity is measured after addition of coelentrazine. Each sample is tested in duplicate. The cut-off values are determined as two-fold the average of the normal controls. Negative controls are an equal volume mixture of sera from healthy blood donors. Results are expressed as the mean RLI (Relative Luminescence Intensity) from duplicate wells, and values are corrected by subtracting the RLI value of the background wells incubated with HEK 293 T cell extracts in the absence of sera. The sensitivity and specificity of the above assay is found to be superior to a commercially available ELISA assays (Euroimmun) for measuring SARS-cov2 antibodies. The presence of SARS-cov2 antibodies detected by the receptor binding domain of S1 protein is found to correlate with neutralizing antibodies to SARS-cov2.

In an alternate embodiment, the serum antibodies are captured using antibodies directed to human IgM or human: IgG subclasses instead of use of Protein G. Thus, for the detection of IgG antibodies against SARS-cov2, the plate is coated overnight with goal anti-Human IgG antibody. Similarly, for the detection of IgM antibodies against SARS-cov2, the plate is coated overnight with goal anti-Human IgM antibody. After three washes with phosphate buffered saline (PBS) containing 0.05% Tween 20 (PBS-T), the plates are incubated with blocking solution (PBS containing 5% non-fat milk) for 1 h at 37° C. Then the wells are washed, and aliquots of serially diluted sera (100 µL) are added to the wells and incubated for 1 h at 37° C. The plates are washed and incubated with 50 µl of diluted marine luciferase fusion proteins (10-100 ng) for 30 min at 37° C. Then the plates are washed again, and luciferase activity is measured after addition of coelentrazine. The sensitivity and specificity of the above assay is found to be superior to a commercially available ELISA assays for measuring SARS-cov2 antibodies. The presence of SARS-cov2 antibodies detected by the receptor binding domain of S1 protein is found to correlate with neutralizing antibodies to SARS-cov2.

All publications, patents, patent applications and sequence accession numbers mentioned herein are hereby incorporated by reference in their entirety as if each individual publication, patent or patent application was specifically and individually indicated to be incorporated by reference. In case of conflict, the present application, including any definitions herein, will control.

Those skilled in the art will recognize, or be able to ascertain using no more than routine experimentation, many equivalents to the specific embodiments of the invention described herein. Such equivalents are intended to be encompassed by the following claims,

SEQUENCE LISTING (1264 sequences)

SEQ ID NO: 1 - DNA, 7488 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 2 - DNA, 6887 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 3 - DNA, 5150 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatctcctaggatccaagaattcggctcgagttcgaagggacgcgtaatgtcgacatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 4 - DNA, 7172 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 5 - DNA, 7181 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgccgctagcgtcgactgatccgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcatcggatcaaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 6 - DNA, 6554 bp, Artificial Sequence
  Synthetic Polynucleotide
cccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagcttggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccggggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagctaattcacaaatggcagtattcatccacaattttaaaagaaaaggggggattggggggtacagtgcaggggaaagaatagtagacataatagcaacagacatacaaactaaagaattacaaaaacaaattacaaaaattcaaaattttcgggtttattacagggacagcagagatccagtttgggaattagcttgatcgattagtccaatttgttaaagacaggatatcagtggtccaggctctagttttgactcaacaatatcaccagctgaagcctatagagtacgagccatagatagaataaaagattttatttagtctccagaaaaaggggggaatgaaagaccccacctgtaggtttggcaagctaggatcaaggttaggaacagagagacagcagaatatgggccaaacaggatatctgtggtaagcagttcctgccccggctcagggccaagaacagttggaacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgatctagatctcgaatcgaattcgtcgacggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggttt

SEQ ID NO: 7 - DNA, 1183 bp, Artificial Sequence
  Synthetic Polynucleotide
gtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 8 - DNA, 5857 bp, Artificial Sequence
  Synthetic Polynucleotide
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcttggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccatactgagtgggtggagactgaagttaggccagcttggcacttgatgtaattctccttggaatttgccctttttgagtttggatcttggttcattctcaagcctcagacagtggttcaaagtttttttcttccatttaaggtgtcgtgaaaactaccccaagctggcctctgaggccaccatggctcgagtttcgaactcaattatactgaattgtttcatcatagggttcaacattgtgataaatcaggacttcaatgtctagtgttcagtaaataccttgtagggctctccaaaaaggggaatcttttcaggaaatgcctctttctcttggtgggcttcctggttgcgtctttccttctctctaattcgaaggcctgtcaggccaagcttggggatcaattctctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 9 - DNA, 7566 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccggggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 10 - DNA, 6884 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcccaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 11 - DNA, 7512 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgagaccgatttctacccctacgatgtgcccgattacgcttagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 12 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 13 - DNA, 2000 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 14 - DNA, 1358 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 15 - DNA, 5016 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 16 - DNA, 2400 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 17 - DNA, 5446 bp, Artificial Sequence
  Synthetic Polynucleotide
gacggatcgggagatctcccgatcccctatggtcgactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttggtaccgagctcggatccactagtaacggccgccagtgtgctggaattctgcagatatccatcacactggcggccgctcgagcatgcatctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcggggcatccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggggatttcggcctattggttaaaaaatgagctgatttaacaaaaatttaacgcgaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcaatgctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 18 - DNA, 10 bp, Artificial Sequence
  Synthetic Polynucleotide
agacaagggt

SEQ ID NO: 19 - DNA, 10 bp, Artificial Sequence
  Synthetic Polynucleotide
acacatctct

SEQ ID NO: 20 - DNA, 10 bp, Artificial Sequence
  Synthetic Polynucleotide
attcatctct

SEQ ID NO: 21 - DNA, 1632 bp, Artificial Sequence
  Synthetic Polynucleotide
atggccgacaagaacatcctgtacggccccgagcctttctaccctctggaagatggaacagccggcgagcagatgttcgacgccctgagcagatatgccgccattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgaggacctcggcggctaccagtgcctgaacaacttcatcagccagaacagcgacagcaacctggacgtgaagaagttcaagccctacagcttcaaccgggacgaccaggtggcctccatcatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaaaattgtgcctctgcacgccgtgaaggtggtggaccctaccacaggcaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctatcaggtggccccagccgagatcgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgaagttcctggacgagatcccaaagggctctaccggcaagatcgacagaaaggtgctgcggcagatgctggaaaagcacaccaatggc

SEQ ID NO: 22 - DNA, 1632 bp, Artificial Sequence
  Synthetic Polynucleotide
atggccgacaagaacatcctgtacggccccgagcctttctaccctctggaagatggaacagccggcgagcagatgttcgacgccctgagcagatacgccgacattcctggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacagcctccagttcttcctgcctgtgatcgccagcctgtacctgggcattattgtggcccctgtgaacgacaagtacatcgagagagagctgatccacagcctgggcatcgtgaagccccggatcgtgttctgctccaagaacaccttccagaaggtgctgaacgtcaagagcaagctgaagtccatcgagacaatcatcatcctggacctgaacgacgacctcggcggctaccagtgcctgaacaacttcatcagccagaacagcgacagcaacctggacgtgaagaagttcaagccctacagcttcaaccgggacgaccaggtggccctgattatgtttagcagcggcaccaccggactgcccaaaggcgttatgctgacccacaagaatatcgtggcccggttctctatcgctaaggaccccaccttcggcaacgccatcaatcctacaagcgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggccttcctggctaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgccaagcctggcagcacaggcaagattgtgcctttccacgccgtgaaggtggtggaccctaccaccggaaagatcctgggacctaatgagcccggcgagctgtacttcaagggacccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcaggactacgtggcctctcaggtgtccacagccaaatggctgagaggcggcgtgatcttcctggacgagatcccaaagggctctaccggcaagatcgacagaaaggtgctgcggcagatgctggaaaagcacaccaatggc

SEQ ID NO: 23 - DNA, 1632 bp, Artificial Sequence
  Synthetic Polynucleotide
atggccgacaagaacatcctgtacggccccgagcctttctaccctctggctgatggaacagccggcgagcagatgttcgatgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttctttctgcctgtgatcgccagcctgtacctgggcattatcgctgcccctgtgtccgataagtacatcgagagagagctgatccacagcctgggcatcgtgaagccccggatcatcttctgctccaagaacaccttccagaaggtgctgaacgtcaagagcaagctgaagtccgtggaaaccatcatcatcctggacctgaacgaggacctcggcggctaccagtgcctgaacaacttcatctctcagaacagcgacagcaacctggacgtgaagaagttcaagccctacagcttcaaccgggacgaccaggtggccctggtcatgtttagctctggcacaaccggcgtgcccaagggcgttatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggccaagtctgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaagggcgacgctagacctggcagcacaggcaagatcgtgcctttccacgccgtgaaggtggtggaccctacaaccggcaagatcctgggacctaatgagcccggcgagctgtactttaagggcgccatgattatgaagggctactacaacaacgaggaagccaccaaggccattatcgacaacgacggctggctgcggagcggcgatattgcctactacgacaatgacggccacttctacatcgtggacagactgaagtccctcatcaagtacaagggctaccaggtcgcccctgccgagattgagggtatcctgctgcaacacccctatatcgtggatgccggcgtgacaggcatccctgatgaagctgctggcgaacttccagcagcaggcgtggtggttcagaccggcaagtacctgaatgagcagatcgtgcaggacttcgtgtccagccaggtgtccacagccaaatggctgagaggcggcgtgaagttcctggacgagatcccaaagggctccaccggaaagatcgacagaaaggtgctgcggcagatgtttgagaagcacaccaacggc

SEQ ID NO: 24 - DNA, 1632 bp, Artificial Sequence
  Synthetic Polynucleotide
atggccgacaagaacatcctgtacggccccgagcctttctaccctctggctgatggaacagccggcgagcagatgttctacgccctgagcagatacgccgacatcagcggatgtatcgccctgacaaacgcccacaccaaagaaaacgtgctgtacgaagagttcctgaagctgagctgtcggctggccgagagcttcaagaagtacggcctgaagcagaacgacacaatcgccgtgtgcagcgagaacggcctccagttcttcctgcctatcattgccagcctgtacctgggcatcattgctgcccctgtgtccgataagtacatcgagagagagctgatccactctctgggcatcgtgaagccccggatcatcttctgctccaagaacaccttccagaaggtgctgaacgtcaagagcaagctgaaatacgtggaaaccatcatcatcctggacctgaacgaggacctcggcggctaccagtgcctgaacaacttcatctctcagaacagcgacatcaacctggacgtcaagaagttcaagccctacagcttcaaccgggacgaccaggtggccctggtcatgtttagctctggcacaaccggcgtgtccaagggcgtgatgctgacccacaagaatatcgtggcccggttcagcctggctaaggaccctaccttcggcaacgccatcaatcccaccaccgctatcctgacagtgatccccttccaccacggcttcggcatgatgaccacactgggctacttcacctgtggcttcagagtggtgctgatgcacaccttcgaggaaaagctgtttctccagagcctccaggactacaaggtggaaagcaccctgctggtgcctactctgatggcctttctggctaagagcgccctggtcgagaagtacgatctgagccacctgaaagagatcgcctctggcggagcccctctgagcaaagaaatcggcgagatggtcaagaagcggttcaagctgaacttcgtgcggcaaggctatggcctgaccgagacaacaagcgccgtgctgattacccctaacaacgatgtgcggcctggcagcacaggcaagatcgtgccttttcacgccgtgaaggtggtggaccctacaaccggcaagatcctgggacctaatgagcccggcgagctgtacttcaagggcgacatgattatgaagggctactacaacaacgaggaagccaccaaggccattatcaacaaggacggctggctgcggagcggcgacattgcctactatgacaacgacggccacttctacatcgtggaccggctgaagtccctgattaagtacaagggctaccaggtcgcccctgccgagattgagggtatcctgctgcaacacccctatatcgtggatgccggcgtgacaggcatccctgatgaagctgctggcgaacttccagcagctggcgtggtggttcagaccggcaagtacctgaatgagcagatcgtgcagaatttcgtgtccagccaggtgtccaccgccaagtggcttagaggcggcgtgaagttcctggacgagatccctaaaggctccaccggaaagatcgacagaaaggtgctgcgccagatgttcgagaagcacaccaatggc

SEQ ID NO: 25 - DNA, 1626 bp, Artificial Sequence
  Synthetic Polynucleotide
atgatgaagcgcgagaagaacgtgatctacggccccgaacctctgcaccctcttgaggatcttacagccggcgagatgctgttcagagccctgcggaaacacagccatctgcctcaggctctggtggatgtcgtgggagatgagagcctgtcctacaaagagttcttcgaggccaccgtgctgctggcccagtctctgcataattgcggctacaagatgaacgacgtggtgtccatctgcgccgagaacaacacccggttcttcatccctgtgatcgccgcctggtacatcggcatgattgtggcccctgtgaacgagagctacatccccgacgagctgtgcaaagtgatgggcatcagcaagccccagatcgtgttcaccaccaagaacatcctgaacaaggtgctggaagtgcagagccggaccaacttcatcaagcggatcatcatcctggacaccgtggaaaacatccacggctgcgagagcctgccaaacggcatctccagatacagcgacggcaatatcgccaacttcaagcccctgcacttcgaccccgtggaacaggtggcagccatcctgtgtagcagcggcacaacaggactgcccaaaggcgtgatgcagacccaccagaatatctgcgtgcggctgatccacgctctggaccctagagctggaacccagctgattcctggcgtgaccgtgctggtgtacctgcctttctttcacgccttcggcttcagcatcaccctgggctacttcatggtcggactgagagtgattatgtttcggcgcttcgaccaagaagccttcctgaaggccatccaggactacgaagtgcgctccgtgattaacgtgcccagcgtgatcctgttcctgagcaagagcccactggtggataagtacgacctgagcagcctgagagagctgtgttgcggagctgcccctctggctaaagaggtggcagaagttgccgccaagcggctgaatctgcctggcatcagatgtggctttggcctgaccgagagcaccagcgccaatatccacagcctgcgggacgagtttaagagcggctctctgggcagagtgacccctctgatggccgccaagatcgccgatagagagacaggcaaagccctgggacctaatcaagtgggcgagctgtgtatcaagggacctatggtgtccaagggctacgtgaacaacgtggaagccaccaaagaggccatcgacgacgacggctggctgcactctggcgatttcggctactacgacgaggacgagcacttctacgtggtggacagatacaaagagctgattaagtacaagggcagccaggtggccccagccgagctggaagaaatcctgctgaagaacccctgcatccgcgacgtggcagttgtgggcattcctgatctggaagccggcgaactgcctagcgcctttgtggttaagcagcccggcaaagagatcaccgccaaagaggtgtacgactacctggccgagagagtgtcccacaccaagtatctgagaggcggcgtcagattcgtggacagcatccccagaaacgtgaccggcaagatcacccggaaagagctgctgaaacagctgctggaaaaggctggcgga

SEQ ID NO: 26 - DNA, 504 bp, Artificial Sequence
  Synthetic Polynucleotide
aagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgac

SEQ ID NO: 27 - DNA, 510 bp, Artificial Sequence
  Synthetic Polynucleotide
gtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcg

SEQ ID NO: 28 - DNA, 441 bp, Artificial Sequence
  Synthetic Polynucleotide
gaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgac

SEQ ID NO: 29 - DNA, 456 bp, Artificial Sequence
  Synthetic Polynucleotide
aaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacaga

SEQ ID NO: 30 - DNA, 615 bp, Artificial Sequence
  Synthetic Polynucleotide
ctgcctgccagccccaccgacagatccatcgtgctggacaacggctacgtgtgcagctgggagggcatccccgacgacctgagagactgccccaagaccgaggacatgagcaagcagcatggcgctgccctgaagctgccccccgatgtgctggacgagatggaatgcaacgccaagaaaagcggctgcgtgcggggctgcctccagtgtctggccctgattaagtgcaccgccaagatgcggaagtacatccccggcagatgccacagctacgagggcgacaaggacattgcccagggcggcatcggcaaagagctgaccatcgacatccccgagatccccggcttcctggacctggcccctatggatcagttcgtggcccaggtggacctgtgcgtggactgctccagcagatgcctgaagggcctggctaacgtgcagtgctcctgcaagctgtataagtggctgcccaccagatgcaccggcttccaggccaagatcaagaaagaggccgacaccgtgatcggactggaagatgccctggccctgggcttcgacaccatccaggcttgtgtggccgctggcaagtgcaaggacaccgtgggcagatacagc

SEQ ID NO: 31 - DNA, 504 bp, Artificial Sequence
  Synthetic Polynucleotide
gccgcctctgaagaggccgatgacgatcacgtgtccctcgtgaagaactactggcggatcggcgtgggcaacgagcgggatgtgtctctggatagaggcggccctcccaagctgagcaaagaactgctggccgagatgcacgccattgccagcaatgccggctgctccagagtgtgcctgatcggcctgagcaagatcaagtgcacccccaagatgaagaccttcctgcccggcagatgcaacaccttcgcccctaaacctgccaccggcgacggaccttttgccgccgctgctgccatccctggcttcagcgatctgaccgctatggaacagtacaaggcccaggtggcccagtgcgactgctccaacagatgcctcgtgggcctggctaacatcaagtgttctgccgccctgaaggccgccctgcctcagagatgtaccacctttgccaccaacatccagaaagagggcgaggtggacagcatcaagggctacggcagaaag

SEQ ID NO: 32 - DNA, 582 bp, Artificial Sequence
  Synthetic Polynucleotide
cagcccaccgagaacaagcaggaaagccagatcgaggacatcgacagaagcaccagcctgggcctgatgtgctacgagcagtgtacaggccagagcggcctggatctgaagtgctacaaagagtgcgccgacttcaccggcgaccggaacagaggcagaaagctgcccggcaagaaactgcccctggaagtgctgaagatcatggaagccaacgccagaagggccggctgcaccagaggctgcctgatctgcctgagcaagatcaagtgcaccgccaagatgaagcagtacatccccggcagatgccacacctacgagggcgacaagtctatcggccagggcggcatcggaggccccatcgtggatatccctgagatcatcggcttccagaacatggaacctatggaacagtttatcgcccaggtggacctgtgcgccgattgcacaaccggctgtctgaagggcctggctaacgtgcggtgcaacgacctgctgaagaagtggctgcccgacagatgcgccggcttcgccaacaagatccagagcgaggtggacaacatcaagggactggccggcgacaga

SEQ ID NO: 33 - DNA, 507 bp, Artificial Sequence
  Synthetic Polynucleotide
aagagcatagacagctacgaaaatattgatatagtggctgttgcgggcaacttcgctgctgttgaccaggacgctaaccgcggaggaaacctgccgggtaagaaaatgccaatagaggttcttaaagaaatggaagctaacgccaagcgagcagggtgtgttcggggctgtttgatatgcttgtcccacatcaaatgcacagctaaaatgaaaaaattcataccaggtcggtgtcatagctatcatggagatgcagatacgaagcaaggggcacttgaagaagtggttgacatgcccgagataccgggatttgtggacatggagcccatggaacagtttatagcccaggtggataaatgcgaggactgtaccactggttgtttgaaaggtctcgccaacgtccactgcagcgatctcctcaagaaatggctgccgcaaagatgctcacagtttgcggataagatccaatccgaggtggacacaataaagggcctggcaggggaccgg

SEQ ID NO: 34 - DNA, 576 bp, Artificial Sequence
  Synthetic Polynucleotide
aacccgacggagaacaaggacgatattgatattgtgggagtggaaggcaaattcgggactacggatcttgaaactgatctctttacgattgttgaggacatgaacgtaatctcaagggatacgaacctggcaaatagtgacgcagaccgaggcaaaatgccgggaaaaaaacttccgttggaagtactgatcgagatggaagcgaatgcacgcaaggcagggtgtacacggggatgcttgatctgtctgagtaagattaaatgcaccgctaaaatgaaagtttatatacccggtcggtgccacgattatgggggcgataagaaaaccggtcaggcagggatcgtcggagcaatcgtggatattcctgaaatttcaggattcaaagaacttggaccaatggagcaatttatagcacaagtggacctctgcgctgactgcacgacgggatgtctgaaaggtcttgcaaatgtaaagtgttcagcactccttaagaaatggcttcccgaccgatgtgcctcttttgctgacaagattcagtctgaagttgataacataaagggtcttgcgggtgatcgg

SEQ ID NO: 35 - DNA, 507 bp, Artificial Sequence
  Synthetic Polynucleotide
aagcctaccgaaaataatgatgatattgatatagttgggatcgcaagtacatttatcacgacaaacaccgacgcggaccggggcaagatgccgggaaagaaacttcccttggcagtcctcaaggaaatggaggcgaacgctgcaaaggcagggtgttccagaggttgtctgatctgcttgtctaaaatcaagtgtacagctaagatgaagcagtttattccggggcgctgtcacgactacggtggtgataaaaaaacgggccaggcggcgctggtcggagcaatattcgacatccctgaaatcttcggatttctcgatatggaacctatcgagcagttcatagcacaagtagatttgtgtgctggctgcacaacaggctgcttgaaaggactcgcaaatattaagtgttctgaactcttgaagaagtggcttccgaaaagatgtacctccttcgcgtataaaatgcaaaaggaaatgcacaatataaaaggcatggcaggagatcgg

SEQ ID NO: 36 - DNA, 507 bp, Artificial Sequence
  Synthetic Polynucleotide
aaagcgaccgaaaacaatgacgacatagacatagttggaatcgcgtcaaccttcataacgacaaacacggacgccgaccgaggcaaaatgccggggaaaagattgccactggcggtgttgaaagagatggaagcgaacgcagtcaaagcgggatgtagcaggggctgccttatatgtctgagtaagattaaatgcaccgcgaagatgaagcaatacatccccggcaggtgccacgattacggaggagacaagaagaccgggcaggcggctatagagggcgcgatagatgatattcctgaaatctctggctttaaggagatggcgcctatggagcaattcattgcgcaggttgacttgtgcgcagactgcacgacaggatgcctcaagggcttggcaaatgtaaaatgttccgaacttctgaaaaaatggctgcccaagaggtgtacctccttcgccacgaagatgcaaaaggagatccataacatcaaaggcatggggggggaccgc

SEQ ID NO: 37 - DNA, 585 bp, Artificial Sequence
  Synthetic Polynucleotide
aaccctacggagacccaggacggagtggacattctcggcgtggaagggaaattcgggacagaaaccaacttggagactgatctgtttaccatttgggagataaatggaataattaaatctgatcgcgacacaaatagggcaaatgcagacgctgatcgaggaaaaatgcccggcaagaaacttcctttggcggtgctcatagagatggaggcaaacgcattcaaagcgggttgcactcgcggttgtctcatttgtttgtccaaaatcaaatgcacggctaagatgaaagagtatatcccaggacggtgccatgattacggtggggataaaaaaacgggacaagcaggtatagtaggtgctatcgtggacattccagaaatctcaggatttaaagagcttggccccatggagcaattcatagcgcaagtagacctttgcgctgattgcactactggctgtcttaagggactggcgaatgttaagtgcagcgccctgttgaagaagtggctgccagaccgatgcgcatcattcgcggataagatacagtccgaagtccataatataaaaggtctcgcaggtgatcgc

SEQ ID NO: 38 - DNA, 519 bp, Artificial Sequence
  Synthetic Polynucleotide
gccacaatcaatgaaaatttcgaagacatcgaccttgtcgcgattggaggctcatttgctacagatgtggacgccaacaggggtggtcatggtggacatccgggcaaaaagatgcctaaagaggtcttgttggaaatggaagcgaacgcaaaacgagccggatgtcataggggttgtttgatttgtctttctcacatcaaatgtacgcagaagatgaagaaattcataccgggacggtgtcactcctatgctggtgacaaggatagcgctcagggcggcataacagaggaggagactgttgacatgcccgagatcgctgggttcaaggatcttgaacctatggagcagtttattgcacaggtagacttgtgcgttgactgcacaactggttgtttgaaagggctggccaacgtccactgttctgacttgctcaaaaagtggctgccttcccggtgcaagacttttgcctcaaaaattcagagtcaggttgacaccatcaaggggttggctggtgacagg

SEQ ID NO: 39 - DNA, 576 bp, Artificial Sequence
  Synthetic Polynucleotide
aatcctacagagaacaatgatcatatcaatattgtcgggatcgagggtaaattcggaatcacagacttggagacggatctcttcactatctgggagacaaatcgcatgatttctaccgataacgaacaggcaaatacagacagtaatagagggaagatgccaggtaagaaactgccattggcagttcttatagagatggaagccaacgctttcaaggcgggttgtacaagaggctgtctcatttgcttgtctaaaatcaagtgtactgctaagatgaagaaatacataccgggaagatgccatgactacggaggtgataagaagactgggcaggcaggaatcgtgggcgcgattgtcgacatacccgacatatccgggttcaaggaaatgggaccgatggagcaattcatcgcccaagtggatcgatgcaccgactgcacaacgggatgtttgaagggtcttgcaaatgttaagtgctccgagctgttgaagaagtggttgccggaccgctgcgcgagtttcgccgataaaattcaaagtgaggtgcataatattaaaggtctggcgggagatcgc

SEQ ID NO: 40 - DNA, 495 bp, Artificial Sequence
  Synthetic Polynucleotide
caacccactgagaataaaaaggaatcctataccgaagacacagacgtaaacggggaccatgatcgaggcaggaagcttccggggaagaaacttccactggaagttctgaaaatcatggaagctaacgcaaggagagcaggttgcacgcgaggctgtttgatatgtcttagcaagataaaatgtactgcaaaaatgaagcaatacataccgggaagatgccatacttatgagggggacaaaagcatagggcaggcaggcataggaggcccaatcattgatataccggaaattatagggtttaagaacatggaaccaatggaacagttcatcgcacaggtggatctctgtgcggactgcactactggatgcctcaaaggtctcgcaaatgtaagatgcaacgatcttttgaaaaaatggttgccagatcgatgcgcggggttcgcactcaagatacaaggtgaagtggaaaacataaaggggatggccggggatcga

SEQ ID NO: 41 - DNA, 615 bp, Artificial Sequence
  Synthetic Polynucleotide
cttccagcgtcacccaccgataggtcaatagtccttgacaacggctatgtgtgttcctgggagggtatcccagacgacctgcgggactgtccgaagacagaggatatgtctaagcagcacggagctgctctcaaactgccgccagatgtgttggatgagatggaatgtaatgctaaaaagagtggatgcgtgcgaggatgtcttcagtgtctggcactcataaaatgtactgcaaaaatgagaaagtatatccccggacgctgtcatagctacgagggtgacaaggacattgctcagggggggatcggaaaggaactgacaattgacatccctgagattcctggcttcttggatcttgcaccaatggaccagttcgtggcgcaggtcgacctctgcgtggactgcagcagtcggtgcctgaagggcttggctaatgtccaatgcagttgtaagctctacaaatggttgccaacccggtgtaccggcttccaagcgaaaataaagaaagaagctgacacggtaattgggctggaagatgcgctcgcactcggattcgacaccatccaggcatgcgtagcggccggtaaatgcaaggatacggttggccggtactct

SEQ ID NO: 42 - DNA, 531 bp, Artificial Sequence
  Synthetic Polynucleotide
tgggcggcctccgaggaggccgatgacgacctcgtatctttggtcaaaaactactggggcgtaggcgtaagcaatgaacgcgatgtatctctcgacagggggggccatggcaagctgccgaaaaagcttagcgttgagattctcgctgaaatggaagcaaacgcccagaagagtaattgctctcgggggtgtctgatagggctttctaaaattaaatgcacgcccaaaatgaaaaaattcctccctggcaggtgccacgaatactctggtgatcccaaaactggacagggtccgcttactgcggctgcggttataccagggtatagtgatcttacagctatggagcagttcaagctccaagtagacaagtgtgactgttcaactcaatgtcttaagggtcttgcaaatgtcaagtgctcagcggccctcaaagcggtgttgccaacaagatgctcacaattcgcaactcagatccaagctgaagtaggcaccataaaagggaaggggaagaaaccgactccaccgataggt

SEQ ID NO: 43 - DNA, 930 bp, Artificial Sequence
  Synthetic Polynucleotide
gcttccaaggtgtacgaccccgagcaacgcaaacgcatgatcactgggcctcagtggtgggctcgctgcaagcaaatgaacgtgctggactccttcatcaactactatgattccgagaagcacgccgagaacgccgtgatttttctgcatggtaacgctgcctccagctacctgtggaggcacgtcgtgcctcacatcgagcccgtggctagatgcatcatccctgatctgatcggaatgggtaagtccggcaagagcgggaatggctcatatcgcctcctggatcactacaagtacctcaccgcttggttcgagctgctgaaccttccaaagaaaatcatctttgtgggccacgactggggggcttgtctggcctttcactactcctacgagcaccaagacaagatcaaggccatcgtccatgctgagagtgtcgtggacgtgatcgagtcctgggacgagtggcctgacatcgaggaggatatcgccctgatcaagagcgaagagggcgagaaaatggtgcttgagaataacttcttcgtcgagaccatgctcccaagcaagatcatgcggaaactggagcctgaggagttcgctgcctacctggagccattcaaggagaagggcgaggttagacggcctaccctctcctggcctcgcgagatccctctcgttaagggaggcaagcccgacgtcgtccagattgtccgcaactacaacgcctaccttcgggccagcgacgatctgcctaagatgttcatcgagtccgaccctgggttcttttccaacgctattgtcgagggagctaagaagttccctaacaccgagttcgtgaaggtgaagggcctccacttcagccaggaggacgctccagatgaaatgggtaagtacatcaagagcttcgtggagcgcgtgctgaagaacgagcag

SEQ ID NO: 44 - skipped

SEQ ID NO: 45 - DNA, 63 bp, Artificial Sequence
  Synthetic Polynucleotide
atggccttaccagtgaccgccttgctcctgccgctggccttgctgctccacgccgccaggccg

SEQ ID NO: 46 - DNA, 63 bp, Artificial Sequence
  Synthetic Polynucleotide
atggccctgcctgtgacagctctgctgctgcctctggcactgctgctgcacgccgccagacct

SEQ ID NO: 47 - DNA, 57 bp, Artificial Sequence
  Synthetic Polynucleotide
atggattggatatggaggatactttttctcgtgggggcagcaaccggggctcattcc

SEQ ID NO: 48 - DNA, 57 bp, Artificial Sequence
  Synthetic Polynucleotide
atggactggatttggcgcatccttttccttgtcggcgctgctaccggcgcgcattcc

SEQ ID NO: 49 - DNA, 60 bp, Artificial Sequence
  Synthetic Polynucleotide
atggcctgtcctggcttcctgtgggctcttgtgatctccacctgtcttgagttcagcatg

SEQ ID NO: 50 - DNA, 57 bp, Artificial Sequence
  Synthetic Polynucleotide
atgaccatccggctgctgtgctatatgggcttctacttcctcggagccggcctgatg

SEQ ID NO: 51 - DNA, 45 bp, Artificial Sequence
  Synthetic Polynucleotide
ggcggaggcggaagtggaggcggaggatctggcggcggaggctct

SEQ ID NO: 52 - DNA, 45 bp, Artificial Sequence
  Synthetic Polynucleotide
ggaggcggaggaagtggcggcggaggatctgggggaggcggaagc

SEQ ID NO: 53 - DNA, 45 bp, Artificial Sequence
  Synthetic Polynucleotide
ggtggcggtggctcgggcggtggtgggtcgggtggcggcggatct

SEQ ID NO: 54 - DNA, 45 bp, Artificial Sequence
  Synthetic Polynucleotide
ggcggcggaggatctggcggaggcggatctgggggcggaggctct

SEQ ID NO: 55 - DNA, 45 bp, Artificial Sequence
  Synthetic Polynucleotide
ggcggtggcggttcaggtggagggggaagcggtggtggtggctca

SEQ ID NO: 56 - DNA, 45 bp, Artificial Sequence
  Synthetic Polynucleotide
ggcggcggaggctcaggcggaggcggatctggcgggggaggatct

SEQ ID NO: 57 - DNA, 105 bp, Artificial Sequence
  Synthetic Polynucleotide
ggaggtagcggctccgggggaggcggaagtggaggcggaggatctgggtctggaggaagcggatctggaggctcagggtcagggggctcaggcagtggaggctct

SEQ ID NO: 58 - DNA, 105 bp, Artificial Sequence
  Synthetic Polynucleotide
ggaggaggcggctccgggggaggcggaagtggaggcggaggatctgggtctggaggaagcggatctggaggctcagggtcagggggctcaggcagtggaggctct

SEQ ID NO: 59 - DNA, 75 bp, Artificial Sequence
  Synthetic Polynucleotide
agcagcgccgacgacgccaagaaggacgccgccaaaaaggatgatgccaagaaagacgatgctaaaaaagacggc

SEQ ID NO: 60 - skipped

SEQ ID NO: 61 - DNA, 18 bp, Artificial Sequence
  Synthetic Polynucleotide
agcggcggaggcggatct

SEQ ID NO: 62 - DNA, 24 bp, Artificial Sequence
  Synthetic Polynucleotide
ggcggaggaagcggcggaggatct

SEQ ID NO: 63 - DNA, 30 bp, Artificial Sequence
  Synthetic Polynucleotide
ggcggaggcggaagtggaggcggaggatct

SEQ ID NO: 64 - DNA, 45 bp, Artificial Sequence; identical to SEQ ID NO: 51
  Synthetic Polynucleotide

SEQ ID NO: 65 - DNA, 36 bp, Artificial Sequence
  Synthetic Polynucleotide
gagcagaaactgatctcggaagaggatgggagcggc

SEQ ID NO: 66 - DNA, 39 bp, Artificial Sequence
  Synthetic Polynucleotide
gaacagaaattgataagtgaggaagacttgggcagcggc

SEQ ID NO: 67 - DNA, 39 bp, Artificial Sequence
  Synthetic Polynucleotide
gagcagaaactgatctcggaagaggatctggggagcggc

SEQ ID NO: 68 - DNA, 51 bp, Artificial Sequence
  Synthetic Polynucleotide
gggaaaccaattcccaaccctcttctgggactggattcaaccggcagcggc

SEQ ID NO: 69 - DNA, 36 bp, Artificial Sequence
  Synthetic Polynucleotide
tacccctacgatgtgcccgattacgctggcagcggc

SEQ ID NO: 70 - DNA, 27 bp, Artificial Sequence
  Synthetic Polynucleotide
caccatcatcaccatcacggcagcggc

SEQ ID NO: 71 - DNA, 45 bp, Artificial Sequence
  Synthetic Polynucleotide
ggcctgaacgacatcttcgaggctcagaagatcgaatggcacgag

SEQ ID NO: 72 - DNA, 39 bp, Artificial Sequence
  Synthetic Polynucleotide
gggtctggaggcggaggcagcggcggaggcgggagcggc

SEQ ID NO: 73 - DNA, 39 bp, Artificial Sequence
  Synthetic Polynucleotide
ggcagcggcggaggcggaagtggaggcggaggcagcggc

SEQ ID NO: 74 - DNA, 33 bp, Artificial Sequence
  Synthetic Polynucleotide
tggtctcatccccagtttgaaaagggcagcggc

SEQ ID NO: 75 - DNA, 33 bp, Artificial Sequence
  Synthetic Polynucleotide
tggtcccatccccagttcgagaaaggcagcggc

SEQ ID NO: 76 - DNA, 34 bp, Artificial Sequence
  Synthetic Polynucleotide
gattataaagatgatgacgataaagggcagcggc

SEQ ID NO: 77 - skipped

SEQ ID NO: 78 - DNA, 423 bp, Artificial Sequence
  Synthetic Polynucleotide
gatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 79 - DNA, 420 bp, Artificial Sequence
  Synthetic Polynucleotide
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 80 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 81 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 82 - DNA, 411 bp, Artificial Sequence
  Synthetic Polynucleotide
cctgatcctgccgtgtaccagctgcgggatagcaagagcagcgacaagagcgtgtgcctgttcaccgacttcgacagccagaccaacgtgtctcagtctaaggatagtgatgtgtatatcaccgacaagaccgtgctggacatgcggagcatggacttcaagagcaacagcgccgtggcctggtccaacaagagcgacttcgcctgcgccaacgccttcaacaacagcatcatccccgaggacaccttcttccccagccccgagagcagctgcgacgtgaaactggtggagaagagcttcgagacagacaccaacctgaacttccagaacctgagcgtgatcggcttcagaatcctgctgctgaaggtggccggcttcaacctgctgatgaccctgcggctgtggagcagc

SEQ ID NO: 83 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 84 - DNA, 411 bp, Artificial Sequence
  Synthetic Polynucleotide
cctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 85 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 86 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 87 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 88 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 89 - DNA, 717 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 90 - DNA, 408 bp, Artificial Sequence
  Synthetic Polynucleotide
atccagaaccctgaacctgccgtgtaccagctgaaggaccccagaagccaggacagcaccctgtgcctgttcaccgacttcgacagccagatcaacgtgcccaagacaatggaaagcggcaccttcatcaccgacaagaccgtgctggacatgaaggctatggacagcaagagcaacggcgccattgcctggtccaaccagaccagcttcacatgccaggacatcttcaaagagacaaacgccacctacccctccagcgacgtgccctgtgacgccaccctgaccgagaagtccttcgagacagacatgaacctcaacttccagaacctgagcgtgatgggcctgcgaatcctgctgctgaaagtggccggcttcaacctgctgatgaccctgcggctgtggtccagc

SEQ ID NO: 91 - DNA, 399 bp, Artificial Sequence
  Synthetic Polynucleotide
gtgcaggaccctgaccctagcgtgtaccagatgagaagccccaagaccggcaggaccgtgtgcctgttcaccgacttcgacagccaggccgacttccagaagcctgagggggccaccgtgatctccctgaacagcaccgtgctggacatgaaagtgatggacagcaagagcaacggcgctctgacctggaacagcgagacaaacatcgagtgcaaagagaacttccagcagcccttctaccccagcagcaactactcctgcgacgccaagctgatcgagaagtccttcgagacagacatggacctgaacttctacaacctgctggtcatcggcctgagaatcctgctgctgaaagtgatcggcttcaacctgttcatgaccctgaggctgtggtcctgc

SEQ ID NO: 92 - DNA, 531 bp, Artificial Sequence
  Synthetic Polynucleotide
gaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 93 - DNA, 537 bp, Artificial Sequence
  Synthetic Polynucleotide
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 94 - DNA, 537 bp, Artificial Sequence; identical to SEQ ID NO: 93
  Synthetic Polynucleotide

SEQ ID NO: 95 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 96 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 97 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 98 - DNA, 534 bp, Artificial Sequence
  Synthetic Polynucleotide
gacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 99 - DNA, 531 bp, Artificial Sequence
  Synthetic Polynucleotide
gaggacctgaagaacgtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgagagctaccagcagggcgtgctgtctgccaccatcctgtacgagatcctgctgggcaaggccaccctgtacgccgtgctggtgtccgccctggtgctgatggctatggtgaagcggaaggacttc

SEQ ID NO: 100 - DNA, 531 bp, Artificial Sequence
  Synthetic Polynucleotide
gaggacctgaacaaggtgttcccacctgaggtggccgtgttcgagcccagcgaggccgagatttcacacactcagaaagccacactcgtatgtctggcgactggtttctttcccgaccacgtggagctgtcttggtgggtgaacggcaaagaggtgcacagcggggtctctaccgacccccagccactgaaagagcagcccgccctgaacgacagccggtactgcctctcttctcggctgagagtgtccgccaccttctggcagaacccccggaaccacttcagatgccaggtgcagttctacggcctgagcgagaacgacgagtggacccaggacagagccaagcctgtgacccagatcgtgagtgctgaagcgtggggacgcgccgattgcggctttaccagcgtgagctaccagcagggcgtgctgtctgccaccatcctgtacgagatcctgctgggcaaggccaccctgtacgccgtgctggtgtccgccctggtgctgatggctatggtgaagcggaaggacttc

SEQ ID NO: 101 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 102 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 103 - DNA, 537 bp, Artificial Sequence
  Synthetic Polynucleotide
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 104 - DNA, 537 bp, Artificial Sequence
  Synthetic Polynucleotide
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgccagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 105 - DNA, 537 bp, Artificial Sequence
  Synthetic Polynucleotide
gaggacctgaagaacgtgttcccacctgaggtggccgtgttcgagcctagcaaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 106 - DNA, 537 bp, Artificial Sequence
  Synthetic Polynucleotide
gaggacctgaagaacgtgttcccacctgaggtggccgtgttcgagcctagcagggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 107 - DNA, 537 bp, Artificial Sequence
  Synthetic Polynucleotide
gaggacctgaagaacgtgttcccacctgaggtggccgtgttcgagcctagcagggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 108 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 109 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 110 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 111 - DNA, 513 bp, Artificial Sequence
  Synthetic Polynucleotide
gaggatctgcggaacgtgaccccacccaaggtgtccctgttcgagcccagcaaggccgagatcgccaataaacagaaggccaccctcgtgtgcctggccagaggcttcttccccgaccacgtggaactgtcttggtgggtcaacggcaaagaggtgcacagcggcgtcagcaccgaccctcaggcctacaaagagagcaactacagctactgcctgagcagtcggctgcgggtgtccgccaccttctggcacaacccccggaaccacttcagatgccaggtgcagttccacggcctgagcgaagaggacaagtggcccgagggcagccccaagcctgtcacccagaacatcagcgccgaggcctggggcagagcctgtggcatcaccagcagctaccagcagggcgtgctgagcgccaccatcctgtacgagatcctgctgggcaaggccaccctgtacgccgtgctggtgtccaccctggtggtcatggctatggtcaagcggaagaacagc

SEQ ID NO: 112 - DNA, 531 bp, Artificial Sequence
  Synthetic Polynucleotide
gaggacctccagaaagtgaccccccctaccgtgaccgtgttcgagccttctgaggccgagatcagccggacccagaaagccacactcgtgtgcctggctcggggcttctaccccgatcacgtggaactgtcttggtgggtcaacggcaaagaagtgaccagcggcttcagcaccgacccccagcctgacaaagagcggcccagcgagaacgacagcagctactgcctgagcagcagactgagagtgtccgccagcttctggcacaacccccggaaccacttcagatgccaggtgcagttctacggcctgggcgacgacgacgagtggaagtacgacagagtgaagcccatcacccagaacatcagcgccgaagcctggggcagagccgattgcggctttacctccgtcagctaccaccagggcgtgctgagcgccaccatcctgtacgagatcctgctgggcaaggccaccctgtacgccgtgctggtgtctatcctggtgctgatggctaaagtgaagcggaagggcagc

SEQ ID NO: 113 - DNA, 828 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 114 - DNA, 807 bp, Artificial Sequence
  Synthetic Polynucleotide
  misc_feature (540)..(540): n is a, c, g, or t
gggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggntcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctcgcctcagggctccttcctccagtcttggagcattttttgcaggtgacctgcctcctcctctgcaggctggagctgcc

SEQ ID NO: 115 - DNA, 774 bp, Artificial Sequence
  Synthetic Polynucleotide
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgct

SEQ ID NO: 116 - DNA, 630 bp, Artificial Sequence
  Synthetic Polynucleotide
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 117 - DNA, 567 bp, Artificial Sequence
  Synthetic Polynucleotide
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 118 - DNA, 519 bp, Artificial Sequence
  Synthetic Polynucleotide
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 119 - DNA, 459 bp, Artificial Sequence
  Synthetic Polynucleotide
agtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttg

SEQ ID NO: 120 - DNA, 459 bp, Artificial Sequence
  Synthetic Polynucleotide
agccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 121 - DNA, 321 bp, Artificial Sequence
  Synthetic Polynucleotide
atccagaaccctgatcctgccgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 122 - DNA, 537 bp, Artificial Sequence
  Synthetic Polynucleotide
gaggacctgaagaacgtgttcccacctgaggtggccgtgttcgagcctagcagggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 123 - DNA, 537 bp, Artificial Sequence
  Synthetic Polynucleotide
gaggacctgaagaacgtgttcccacctgaggtggccgtgttcgagcctagcagggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 124 - DNA, 90 bp, Artificial Sequence
  Synthetic Polynucleotide
cagagcttcggcctgctggaccccaagctgtgctacctgctggatggcatcctgttcatctacggcgtgatcctgaccgccctgttcctg

SEQ ID NO: 125 - DNA, 429 bp, Artificial Sequence
  Synthetic Polynucleotide
cagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 126 - DNA, 429 bp, Artificial Sequence; identical to SEQ ID NO: 125
  Synthetic Polynucleotide

SEQ ID NO: 127 - DNA, 123 bp, Artificial Sequence
  Synthetic Polynucleotide
aggagtaagaggagcaggctcctgcacagtgactacatgaacatgactccacgccgccccggacccacccgcaagcattaccagccctatgccccaccacgcgacttcgcagcctatcgctcc

SEQ ID NO: 128 - DNA, 126 bp, Artificial Sequence
  Synthetic Polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 129 - DNA, 165 bp, Artificial Sequence
  Synthetic Polynucleotide
aagaaccggaaggccaaggccaagcctgtgacaagaggtgctggtgctggcggcagacagagaggccagaacaaagaaagacctcctcctgtgcctaatcctgactacgagcccatcagaaaaggccagcgggatctgtacagcggcctgaaccagcggcggatc

SEQ ID NO: 130 - DNA, 90 bp, Artificial Sequence
  Synthetic Polynucleotide
cagagttttgggttgttggaccctaaattgtgctatctgttggacggaatcctgttcatttacggagtgatcctgaccgcattgttcctg

SEQ ID NO: 131 - DNA, 339 bp, Artificial Sequence
  Synthetic Polynucleotide
cgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 132 - DNA, 429 bp, Artificial Sequence
  Synthetic Polynucleotide
cagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 133 - DNA, 123 bp, Artificial Sequence
  Synthetic Polynucleotide
aggagcaagcggtcacggctgctccacagcgattacatgaatatgacaccacgaagaccgggtcctactcgcaaacactaccaaccctacgcacctccccgcgactttgcagcgtaccgatct

SEQ ID NO: 134 - DNA, 126 bp, Artificial Sequence
  Synthetic Polynucleotide
aagagaggccggaagaagctgctgtacatcttcaagcagcctttcatgcggcccgtgcagaccacccaggaagaggacggctgctcctgccggttccccgaggaagaagaaggcggctgcgagctg

SEQ ID NO: 135 - DNA, 552 bp, Artificial Sequence
  Synthetic Polynucleotide
cagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 136 - DNA, 555 bp, Artificial Sequence
  Synthetic Polynucleotide
cagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 137 - DNA, 552 bp, Artificial Sequence
  Synthetic Polynucleotide
cagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 138 - DNA, 555 bp, Artificial Sequence
  Synthetic Polynucleotide
cagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 139 - DNA, 180 bp, Artificial Sequence
  Synthetic Polynucleotide
atccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 140 - DNA, 159 bp, Artificial Sequence
  Synthetic Polynucleotide
ggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 141 - DNA, 201 bp, Artificial Sequence
  Synthetic Polynucleotide
cccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 142 - DNA, 204 bp, Artificial Sequence
  Synthetic Polynucleotide
gaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 143 - DNA, 318 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagc

SEQ ID NO: 144 - DNA, 309 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgt

SEQ ID NO: 145 - DNA, 306 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagc

SEQ ID NO: 146 - DNA, 339 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgataaaactcatacctgtccgccatgcccg

SEQ ID NO: 147 - DNA, 309 bp, Artificial Sequence
  Synthetic Polynucleotide
gctagtaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgt

SEQ ID NO: 148 - DNA, 306 bp, Artificial Sequence
  Synthetic Polynucleotide
gctagtaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatct

SEQ ID NO: 149 - DNA, 339 bp, Artificial Sequence
  Synthetic Polynucleotide
gctagtaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgccca

SEQ ID NO: 150 - DNA, 303 bp, Artificial Sequence
  Synthetic Polynucleotide
gcctcaacgaaagggcctagcgtcttccccctggcgccgtgctcacgatccacaagcgaatccaccgccgctctcggatgcctcgtaaaggattatttccctgaaccagtcacggtgtcatggaacagcggtgcccttaccagcggcgtccatacctttcctgctgtgctccagtccagcggactttatagtctcagctctgtcgtgaccgtcccttcctctaattttggcacccagacttacacgtgcaacgtcgatcataagcccagtaacaccaaggtagacaagacggtggaacgaaag

SEQ ID NO: 151 - DNA, 306 bp, Artificial Sequence
  Synthetic Polynucleotide
gcctccacgaagggaccatctgttttccctcttgccccctgctcacggtcaacgtctgaatccacggcagccctgggctgcctcgttaaggactactttccagagccggtaacagtctcctggaacagtggagcccttacatcaggtgttcacactttccctgccgtcttgcaaagtagcggactgtacagccttagttccgttgttacggttccttctagcaacttcggtacacagacatatacttgtaacgtagatcataagcctagcaacaccaaggtggacaaaaccgtagagagaaagtgt

SEQ ID NO: 152 - DNA, 309 bp, Artificial Sequence
  Synthetic Polynucleotide
gcaagtacaaagggacccagtgttttcccgctcgccccctgttcacgatcaacgagtgagtccactgcggctctcggatgcctcgtcaaagactacttccccgagccggtgactgttagttggaactctggggctcttacttcaggcgtacacacattccccgccgtgcttcagtcaagtgggctctactcacttagcagtgtggtaacggttccctctagcaactttggcacccaaacatatacttgcaacgtcgatcacaagccgtcaaataccaaagttgacaagaccgttgaaaggaaatgttgt

SEQ ID NO: 153 - DNA, 309 bp, Artificial Sequence
  Synthetic Polynucleotide
gcgtccactaagggtccgtcagtcttcccgctggcgccctgttcccgcagcacgagtgaatctaccgccgcccttgggtgcttggtaaaagactattttcctgagcccgttacagtatcatggaacagcggggctctgactagcggggtgcatacgttccctgcggttctgcaatctagcggactgtattctctctccagtgttgtgaccgtgccaagctccagcctcggtactaaaacttatacatgtaatgtggatcataaaccttcaaataccaaggttgacaaaagggtagagagtaagtacggt

SEQ ID NO: 154 - DNA, 363 bp, Artificial Sequence
  Synthetic Polynucleotide
gcgtctcccacttctccgaaagttttccccctttccctctgtagcacacaacctgatggaaatgtggtcatcgcatgtctggtacaaggattctttccacaagagccattgagcgttacatggtcagagagcgggcagggagttaccgctaggaatttcccaccctcacaggatgcgagtggtgatctttataccacatcatcacaactcacgttgccagccactcagtgcctcgctggaaagtcagtaacatgccatgtcaaacattacactaatccctcacaagatgttaccgtgccttgcccagtaccttctacgccgcccaccccgtctccatctactccacccacgccatcacctagt

SEQ ID NO: 155 - DNA, 324 bp, Artificial Sequence
  Synthetic Polynucleotide
gcgtcacctacgtccccaaaagtgttcccgctgtcactcgattccactccacaggacggtaacgtggtggttgcctgcctggtacaaggtttctttcctcaagaaccactctctgtgacgtggtctgaaagtggtcagaatgttacagcacggaacttcccaccgagtcaagatgcgagtggggatctctatacgacatccagtcaactcacactgcccgcaacacaatgccccgatggcaaatctgttacctgccatgtgaaacattacaccaatccatcccaggatgtgacagtaccttgtccggttccgccccctcccccg

SEQ ID NO: 156 - DNA, 477 bp, Artificial Sequence
  Synthetic Polynucleotide
gctccgacaaaggcgccagacgtttttcctattatttcaggatgtcggcatccgaaagataattccccagttgttctggcgtgtcttatcacgggctaccatcctacatctgttaccgttacgtggtatatgggtacgcaaagccaacctcagcggacttttccagagatccaacggcgagattcatattatatgacatccagtcagttgagtacaccgctgcaacagtggcggcaaggtgagtataagtgtgtggtccaacacacagccagtaaaagtaagaaagagatattccggtggcctgaaagcccgaaggcacaagcatcttctgttccgacggcgcaaccgcaagctgaaggaagtcttgcaaaagcaaccacagcacccgcgacaacacgaaacacaggacgcggaggcgaggaaaagaaaaaagaaaaggaaaaggaagagcaagaggagagggaaactaagaccccc

SEQ ID NO: 157 - DNA, 309 bp, Artificial Sequence
  Synthetic Polynucleotide
gctagtacccagtcaccttctgttttcccgcttactagatgctgcaagaacataccatccaatgccacttctgtcacactgggctgtcttgctacaggttattttcctgagccggtgatggtcacttgggataccggtagcctgaatggaactacaatgacgctgcctgccacgacgctcacattgagtgggcattacgcgacaattagtcttttgacggtaagcggagcttgggctaagcagatgttcacttgcagagtagcgcacactccctctagtactgactgggttgacaacaaaaccttttct

SEQ ID NO: 158 - DNA, 312 bp, Artificial Sequence
  Synthetic Polynucleotide
gggtcagcaagtgcgcccacgctctttccattggtttcttgcgagaactctccctcagacacatcaagtgtcgcggtaggctgtctcgcccaagattttttgcccgatagtataacgctgtcatggaaatataagaacaatagtgatataagctccacaaggggttttccgagcgtactgcgaggcggtaaatatgcagcgacgagtcaagtcttgctcccatccaaggatgtcatgcaaggcaccgatgagcatgttgtttgcaaagtgcaacatccgaatggaaataaggaaaaaaacgtcccgctgccc

SEQ ID NO: 159 - DNA, 282 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgc

SEQ ID NO: 160 - DNA, 378 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctgg

SEQ ID NO: 161 - DNA, 342 bp, Artificial Sequence
  Synthetic Polynucleotide
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattaca

SEQ ID NO: 162 - DNA, 276 bp, Artificial Sequence
  Synthetic Polynucleotide
agccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccacc

SEQ ID NO: 163 - DNA, 63 bp, Artificial Sequence
  Synthetic Polynucleotide
gacgtgaagctggtggaaaagagcttcgagacagacaccaacctgaacttccagaacctgagc

SEQ ID NO: 164 - DNA, 57 bp, Artificial Sequence
  Synthetic Polynucleotide
ggcagagccgattgcggctttaccagcgagagctaccagcagggcgtgctgagcgcc

SEQ ID NO: 165 - DNA, 72 bp, Artificial Sequence
  Synthetic Polynucleotide
atggaccccaaggacaactgctccaaggacgccaacgataccctgctgctccagctgaccaacaccagcgcc

SEQ ID NO: 166 - DNA, 132 bp, Artificial Sequence
  Synthetic Polynucleotide
gaagtgaaaaccgactccaccgaccacgtgaagcccaaagagacagagaacaccaagcagcccagcaagagctgccacaagcccaaggccatcgtgcacaccgagaaagtgaacatgatgagcctgaccgtg

SEQ ID NO: 167 - DNA, 60 bp, Artificial Sequence
  Synthetic Polynucleotide
gtgatcggcttcagaatcctgctgctgaaagtggccggctttaacctgctgatgaccctg

SEQ ID NO: 168 - DNA, 69 bp, Artificial Sequence
  Synthetic Polynucleotide
accatcctgtacgagatcctgctgggcaaggccaccctgtacgccgtgctggtgtctgccctggtgctg

SEQ ID NO: 169 - DNA, 69 bp, Artificial Sequence
  Synthetic Polynucleotide
tactacatgtacttgttgctgctgctgaagtccgtggtgtacttcgccatcatcacatgctgcctgctg

SEQ ID NO: 170 - DNA, 69 bp, Artificial Sequence
  Synthetic Polynucleotide
ctgggcctgcggatgctgttcgccaaaaccgtggccgtgaacttcctgctgaccgccaagctgttcttc

SEQ ID NO: 171 - DNA, 60 bp, Artificial Sequence
  Synthetic Polynucleotide
tgctatctgttggacggaatcctgttcatttacggagtgatcctgaccgcattgttcctg

SEQ ID NO: 172 - DNA, 27 bp, Artificial Sequence
  Synthetic Polynucleotide
tgctgcgttgaatgtccgccgtgtcct

SEQ ID NO: 173 - DNA, 702 bp, Artificial Sequence
  Synthetic Polynucleotide
cctgctgaacccaaatccccagacaagacacatacctgccccccttgccctgcgcctcccgtcgccgggccttctgtcttccttttccctcccaagcccaaagacacgttgatgattgcccgaactccagaggtaacgtgtgttgtcgtcgatgttagccatgaggacccagaggttaagttcaattggtatgtggacggtgttgaagttcataatgctaagacaaaacctagggaggaacaatacaattcaacatatcgggtcgtcagtgtcctcaccgtccttcaccaagattggctcaatggtaaagaatataagtgcaaagtctcaaataaggcgcttcctgcgcccatcgaaaaaaccatttccaaggccaagggacaacctagagagccacaggtgtatacgcttccgccgagtcgggatgaattgacgaaaaaccaggtgagcctgacatgcttggtcaaagggttttatccaagcgacattgctgtcgagtgggaatccaacggccagcctgaaaataactacaaaaccacaccgcccgtactggacagtgacggatcattcttcctgtactctaaactcaccgttgacaaatcccggtggcaacagggtaatgtctttagttgcagtgtcatgcatgaggctctgcacaatcattatacccagaaaagtctgagtctgtcacccggtaaaaaa

SEQ ID NO: 174 - DNA, 705 bp, Artificial Sequence
  Synthetic Polynucleotide
ccagctgaaccaaaaagtcccgataaaacgcatacctgtccaccatgcccagcgccccctgtcgctgggccaagtgtttttctgtttcctccgaagccaaaggatacgctgatgattgcaagaactccagaagtcacctgcgtcgtcgtggatgtttctcacgaggacccagaggtaaagttcaactggtatgtagacggagtcgaagtacacaatgctaaaaccaaaccgcgcgaggaacaatacaattcaacttaccgggtcgtatctgtgcttaccgtcctccaccaagattggctgaatgggaaagaatacaaatgcaaagtcagtaataaggcgctgccggcacctatcgaaaagacgatctctaaggcaaaggggcagcccagagaaccgcaagtgtatacgcttccgccatcacgagatgagctgacgaagaaccaagtctcattgacttgcttggtgaaaggcttctacccgtccgacatagccgtggaatgggaaagcaatggtcaacctgagaataactacaagacaacacccccagttctcgacagcgatggtagcttctttttgtatagtaagttgacggtagataagtcacggtggcagcaaggcaacgtattcagttgtagtgtaatgcatgaagcactccataaccattatactcaaaagagcctttcttcactttctcctggaaagaaa

SEQ ID NO: 175 - DNA, 687 bp, Artificial Sequence
  Synthetic Polynucleotide
gaaagtaagtatggccctccgtgccctccgtgccccgcaccggaatttgagggcggaccatccgtgttcctttttccaccaaaacccaaagacacacttatgatttccaggacccctgaagtcacctgcgtcgtggtagacgtttctcaggaagatccggaggttcaatttaactggtacgttgacggtgtagaagtacacaatgccaagactaagccacgggaggagcaatttaattcaacatacagggtagtatcagtcttgacagtattgcaccaggattggctgaacggaaaagagtataagtgtaaggtatctaacaagggtctcccgtcatccatcgagaaaacgatcagtaaagcaaaagggcagccacgggaaccacaagtgtacacactgccacccagtcaagaggagatgactaagaatcaagtaagtcttacgtgtctcgtcaaggggttttatccgtcagacattgctgttgagtgggaatccaatgggcaacccgagaacaattataagaccacaccaccagtccttgatagcgatggcagtttttttctgtactccagactcacagtagataagagccggtggcaggagggcaatgttttctcctgcagcgttatgcacgaagcgcttcataaccactatactcagaaatccttgagtctgagtctcggcaaa

SEQ ID NO: 176 - DNA, 357 bp, Artificial Sequence
  Synthetic Polynucleotide
gagagtaaatacggtccgccgtgtccaccgtgccctggacagccgagggaaccacaggtttacactttgccaccgtcacaggaagaaatgactaaaaaccaggtcagcctcacttgtctggttaagggcttctaccccagcgacattgctgtggagtgggagagcaacggccagccagagaataattacaagaccacgccgcctgtgttggacagtgatggtagtttctttttgtactcacggcttacagtcgacaagagccggtggcaggaaggcaacgttttcagttgctcagtaatgcacgaagccttgcacaaccattatacccaaaaatcactgtcattgagtctcggtaag

SEQ ID NO: 177 - DNA, 36 bp, Artificial Sequence
  Synthetic Polynucleotide
gaatcaaagtacggccccccgtgtcctccatgtcct

SEQ ID NO: 178 - DNA, 336 bp, Artificial Sequence
  Synthetic Polynucleotide
agagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 179 - DNA, 336 bp, Artificial Sequence
  Synthetic Polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 180 - DNA, 126 bp, Artificial Sequence; identical to SEQ ID NO: 128
  Synthetic Polynucleotide

SEQ ID NO: 181 - DNA, 216 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgc

SEQ ID NO: 182 - DNA, 678 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 183 - DNA, 342 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 184 - DNA, 324 bp, Artificial Sequence
  Synthetic Polynucleotide
aaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctcc

SEQ ID NO: 185 - DNA, 450 bp, Artificial Sequence
  Synthetic Polynucleotide
ttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 186 - DNA, 555 bp, Artificial Sequence
  Synthetic Polynucleotide
gacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgcaaaatccagattatgagcctattcggaaaggacagagggacctgtactctggcctgaatcagagaagaatc

SEQ ID NO: 187 - DNA, 480 bp, Artificial Sequence
  Synthetic Polynucleotide
cagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 188 - DNA, 429 bp, Artificial Sequence; identical to SEQ ID NO: 132
  Synthetic Polynucleotide

SEQ ID NO: 189 - skipped

SEQ ID NO: 190 - DNA, 597 bp, Artificial Sequence
  Synthetic Polynucleotide
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 191 - DNA, 396 bp, Artificial Sequence
  Synthetic Polynucleotide
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggc

SEQ ID NO: 192 - DNA, 516 bp, Artificial Sequence
  Synthetic Polynucleotide
atgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtg

SEQ ID NO: 193 - DNA, 1071 bp, Artificial Sequence
  Synthetic Polynucleotide
atgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatg

SEQ ID NO: 194 - DNA, 1272 bp, Artificial Sequence
  Synthetic Polynucleotide
atgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcct

SEQ ID NO: 195 - DNA, 999 bp, Artificial Sequence
  Synthetic Polynucleotide
atgccccctcccagactgctgttcttcctgctgttcctgacccctatggaagtgcggcccgaggaacccctggtcgtgaaagtggaagagggcgacaacgccgtgctccagtgtctgaagggcacctccgatggccctacccagcagctgacatggtccagagagagccccctgaagcccttcctgaagctgtctctgggcctgcctggcctgggcatccacatgaggccactggctatctggctgttcatcttcaacgtgtcccagcagatgggcggcttctacctgtgtcagcctggccccccaagcgagaaagcctggcagcctggctggaccgtgaacgtggaaggatctggcgagctgttccggtggaacgtgtccgatctgggcggcctgggatgcggcctgaagaacagaagcagcgaaggccccagcagccccagcggcaaactgatgagccccaagctgtacgtgtgggccaaggaccggcccgagatttgggaaggcgagcctccttgcctgccccccagagatagcctgaaccagagcctgagccaggacctgacaatggcccctggcagcacactgtggctgagctgtggcgtgccacccgactctgtgtccagaggccctctgagctggacccacgtgcaccccaagggacctaagagcctgctgagcctggaactgaaggacgacagacccgccagagatatgtgggtcatggaaaccggcctgctgctgcctagagccacagcccaggatgccggcaagtattactgccaccggggcaacctgaccatgagcttccacctggaaatcaccgccagacccgtgctgtggcactggctgctgagaaccggcggatggaaagtgtccgccgtgaccctggcctacctgatcttctgcctgtgctccctcgtgggcatcctgcatctccagcgggctctggtgctgcggcggaagagaaagagaatgaccgaccccacccggcggttc

SEQ ID NO: 196 - DNA, 315 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactct

SEQ ID NO: 197 - DNA, 564 bp, Artificial Sequence
  Synthetic Polynucleotide
atggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 198 - DNA, 723 bp, Artificial Sequence
  Synthetic Polynucleotide
atgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgact

SEQ ID NO: 199 - DNA, 564 bp, Artificial Sequence
  Synthetic Polynucleotide
atggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 200 - DNA, 1200 bp, Artificial Sequence
  Synthetic Polynucleotide
atgctggaaggcgtgcaggtggaaaccatcagccctggcgacggcagaaccttccctaagaggggccagacctgcgtggtgcactacaccggaatgctggaagatggcaagaaggtggacagcagccgggaccggaacaagcccttcaagttcatgctgggcaagcaggaagtgatccggggctgggaagagggcgtggcccagatgtctgtgggccagagagccaagctgaccatctcccccgattacgcctacggcgctacaggccaccctggcatcattcctccacacgccacactggtgttcgacgtggaactgctgaagctggaaagcggcggaggcagcggagtggatggcttcggagatgtgggagccctggaaagcctgagaggcaacgccgacctggcctacatcctgagcatggaaccttgcggccactgcctgattatcaacaacgtgaacttctgccgcgagagcggcctgagaaccagaaccggcagcaacatcgactgcgagaagctgcggcggagattcagcagcctgcacttcatggtggaagtgaagggcgacctgaccgccaagaaaatggtgctggccctgctggaactggcccagcaggatcatggcgctctggactgctgtgtggtcgtgatcctgagccacggctgccaggcttcccatcttcagttccctggcgctgtgtacggcaccgatggctgtcctgtgtccgtggaaaagatcgtgaacatcttcaacggcaccagctgccccagcctgggcggaaagcccaagctgttctttattcaagcctgtggcggcgagcagaaggaccacggctttgaggtggcctccaccagccctgaggatgagagccctggcagcaaccctgagcctgacgccaccccattccaggaaggactgcggaccttcgaccagctggacgccatctctagcctgcccacccccagcgacatcttcgtgtcctacagcaccttccccggctttgtgtcctggcgggaccctaagagcggctcttggtacgtggaaaccctggacgacatctttgagcagtgggctcacagcgaggacctccagagcctgctgctgagagtggctaacgccgtgtccgtgaagggcatctacaagcagatgcctggctgcttcaacttcctgcggaagaagctgtttttcaagaccagc

SEQ ID NO: 201 - DNA, 810 bp, Artificial Sequence
  Synthetic Polynucleotide
atggattggatatggaggatactttttctcgtgggggcagcaaccggggctcattccgaggttcagttggtcgaatcaggcgggggcctcgtccaacccggcggaagcctgcggctgtcttgcgcagcaagtggtagtgtgttcaagatcaacgttatggcctggtatcgccaggctccgggaaaagggagagagctggttgcggggatcattagcggtggctccaccagctacgctgacagtgtgaagggaaggttcactatatcacgcgacaacgcaaagaatacattgtacctccagatgaatagcttgcggcccgaagacacggcagtctactattgtgcctttatcacaacagagagcgactatgacctgggccgccggtattgggggcagggaacccttgtgaccgtttcatccggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 202 - DNA, 738 bp, Artificial Sequence
  Synthetic Polynucleotide
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagc

SEQ ID NO: 203 - DNA, 759 bp, Artificial Sequence
  Synthetic Polynucleotide
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctct

SEQ ID NO: 204 - DNA, 789 bp, Artificial Sequence
  Synthetic Polynucleotide
atggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatct

SEQ ID NO: 205 - DNA, 1128 bp, Artificial Sequence
  Synthetic Polynucleotide
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcgaggacttcgccgtgtactactgccagcagagcaccttcggccagggcaccaaggtggaaatcaagggcggaggcggatctggcggcggaggatctgggggaggcggctctcaggtgtacctggtggaaagcggagggggcgtggtgcagcctggaagaagcctgagactgagctgtgccgccagcggcttcaccttcagcaactacggaatgcactgggtgcgccaggcccctggcaaaggactggaatgggtggccctgatttggtacgacggcagcaacaagtattacgccgacagcgtgaagggccggttcaccatcagccgggacaacagcaagaacaccctgtacctccagatgaccagcctgcgggtggaagataccgccgtgtattattgcgccagcaacgtggaccactggggccagggaacactcgtgaccgtgtctagcggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 206 - DNA, 1149 bp, Artificial Sequence
  Synthetic Polynucleotide
atggccctgcctgtgacagctctgctgctgcctctggcactgctgctgcacgccgccagacctgagatcgtgctgacacagagccctgccaccctgtctctgagccctggcgaaagagccaccctgagctgtagagccagccagagcgtgtccagctacctggcctggtatcagcagaagcccggccaggctccccggctgctgatctacgatgccagcaatagagccaccggcatccccgccagattttccggctctggcagcggcaccgacttcaccctgaccatcagctccctggaacccgaggacttcgccgtgtactactgccagcagagcagcaactggccccggacctttggacagggcaccaaggtggaaatcaagggcggaggcggatctggcggcggaggatctgggggaggcggctctcaggtgcagctggtggaaagtgggggaggatggcagcctggcagaagcctgagactggactgcaaggccagcggcatcaccttcagcaacagcggaatgcactgggtgcgccaggcccctggaaagggactggaatgggtggccgtgatctatgacggcagcaagcggtactacgccgacagcgtgaagggccggttcatcagccgggacaacagcaagaataccctgttcctccagatgaacagcctgcgggccgaggacacagccgtgtattattgcgccaccaacgacgactactggggccagggaacactcgtgaccgtgtcctctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 207 - DNA, 1179 bp, Artificial Sequence
  Synthetic Polynucleotide
atggccctgcctgtgacagctctgctgctgcctctggcactgctgctgcacgccgccagacctgagatcgtgctgacacagagccctggcacactgtcactgtctccaggcgaaagagccacactgagctgtagagcctctcagagcgtgggcagctcttacctggcttggtatcagcagaagcccggacaggctcccagactgctgatctacggcgctttcagcagagccacaggcatccccgatagattttctggcagcggctccggcaccgacttcaccctgacaatcagcagactggaacccgaggacttcgccgtgtactactgtcagcagtacggcagcagcccttggacctttggacagggcaccaaggtggaaatcaagagaggcggaggcggaagtggaggcggaggatctggcggcggaggctctcaagtgcagctggttgaatcaggtggcggcgttgtgcagcctggcagaagtctgagactgtcttgtgccgccagcggcttcaccttcagcagctacacaatgcactgggtccgacaggcccctggcaaaggactggaatgggtcacctttatcagctacgacggcaacaacaagtattacgccgacagcgtgaagggcagattcaccatctccagagacaacagcaagaacaccctgtacctccagatgaacagcctgagagccgaggacaccgccatctactactgcgccagaacaggatggctgggacccttcgattattggggccagggcacactcgtgaccgtgtcatctggcggaggcggaagtggaggcggaggatctggcggcggaggctctgaggtgcagctcgtggaatcaggcggaggtcttgtacagccaggaaattctcttcggctgtcttgcgccgcgagcgggttcaccttcagcagcttcggaatgagctgggtaagacaggcaccggggaaaggcctggagtgggtgagctcaatcagtgggagcgggtcagataccctgtacgcggattccgtgaagggcagattcacaatctctcgggacaatgctaagacaacactttaccttcagatgaactctctgcgacccgaggataccgctgtctactactgtacaataggaggttctctgtccagaagttctcaagggacactggtgaccgtctccagc

SEQ ID NO: 208 - DNA, 777 bp, Artificial Sequence
  Synthetic Polynucleotide
atggactggatttggcgcatccttttccttgtcggcgctgctaccggcgcgcattctgagattgtactgactcagtctcccgctactctgtccctttcccccggcgaacgcgcgaccctctcatgctcagccagcatctctgtgtcttacatgtattggtatcagcaaaagcctgggcaagcgccaagactgctgatatacgacatgtccaacctggcaagcggcatcccggcgagattctccggatctggctcagggaccgattttacgctcactatcagttccttggagcctgaggatttcgcggtgtattactgtatgcagtggagcggttatccttacacatttggaggcggaactaaagtggagataaagggcggtggcggttcaggtggagggggaagcggtggtggtggctcagaggtgcaactcgtggagtccggtggcggtctggtgcagccaggggggtccttgcgcctgagctgcgccgcttctgggtttacgttttccccattcgctatgtcctgggtccggcaggcgcccggtaaaggtctggaatgggtggcaaagatttccccaggggggtcttggacttattactccgacaccgtgacaggtcgatttaccatcagcagggataacgccaaaaacagcctctacctccagatgaactccttgcgagccgaagataccgccgtctattactgtgccaggcagctgtggggatactacgcgctggacatttgggggcagggaacaactgtgactgtatcctca

SEQ ID NO: 209 - DNA, 141 bp, Artificial Sequence
  Synthetic Polynucleotide
atggactggatttggcgcatccttttccttgtcggcgctgctaccggcgcgcattctggccacagaccactggacaagaagcgggaagaggcgccctccctgcgcccagctcctccacccatcagtgggggtggctacaga

SEQ ID NO: 210 - DNA, 903 bp, Artificial Sequence
  Synthetic Polynucleotide
atgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 211 - DNA, 1224 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 212 - DNA, 225 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggt

SEQ ID NO: 213 - DNA, 339 bp, Artificial Sequence
  Synthetic Polynucleotide
gacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaa

SEQ ID NO: 214 - DNA, 324 bp, Artificial Sequence
  Synthetic Polynucleotide
gacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaa

SEQ ID NO: 215 - DNA, 339 bp, Artificial Sequence
  Synthetic Polynucleotide
gacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaa

SEQ ID NO: 216 - skipped

SEQ ID NO: 217 - DNA, 351 bp, Artificial Sequence
  Synthetic Polynucleotide
caaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagtt

SEQ ID NO: 218 - DNA, 345 bp, Artificial Sequence
  Synthetic Polynucleotide
gaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctct

SEQ ID NO: 219 - DNA, 378 bp, Artificial Sequence
  Synthetic Polynucleotide
caagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttct

SEQ ID NO: 220 - DNA, 16 bp, Artificial Sequence
  Synthetic Polynucleotide
gggggggggggggggg

SEQ ID NO: 221 - DNA, 735 bp, Artificial Sequence
  Synthetic Polynucleotide
gacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagtt

SEQ ID NO: 222 - DNA, 714 bp, Artificial Sequence
  Synthetic Polynucleotide
gacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctct

SEQ ID NO: 223 - DNA, 762 bp, Artificial Sequence
  Synthetic Polynucleotide
gacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttct

SEQ ID NO: 224 - DNA, 1833 bp, Artificial Sequence
  Synthetic Polynucleotide
gacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacaca

SEQ ID NO: 225 - DNA, 486 bp, Artificial Sequence
  Synthetic Polynucleotide
atgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctgg

SEQ ID NO: 226 - DNA, 717 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtgctagcatgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctgg

SEQ ID NO: 227 - DNA, 708 bp, Artificial Sequence
  Synthetic Polynucleotide
atgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggtaa

SEQ ID NO: 228 - DNA, 933 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtatgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggtaa

SEQ ID NO: 229 - DNA, 999 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagctaactcgag

SEQ ID NO: 230 - DNA, 669 bp, Artificial Sequence
  Synthetic Polynucleotide
agagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttc

SEQ ID NO: 231 - DNA, 3822 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 232 - DNA, 1257 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcc

SEQ ID NO: 233 - DNA, 666 bp, Artificial Sequence
  Synthetic Polynucleotide
atggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacag

SEQ ID NO: 234 - DNA, 825 bp, Artificial Sequence
  Synthetic Polynucleotide
atggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttg

SEQ ID NO: 235 - DNA, 2418 bp, Artificial Sequence
  Synthetic Polynucleotide
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccatatggctgattgtttttggagttgtgatgggagtgatagtggttggcattgtcatcctgatcttcactgggatcagagatcggaagaagaaaaataaagcaagaagtggagaaaatccttatgcctccatcgatattagcaaaggagaaaataatccaggattccaaaacactgatgatgttcagacctccttttag

SEQ ID NO: 236 - DNA, 1479 bp, Artificial Sequence
  Synthetic Polynucleotide
atggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggattgtgggcggcgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaa

SEQ ID NO: 237 - DNA, 954 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaacttt

SEQ ID NO: 238 - DNA, 2199 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 239 - DNA, 2202 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 240 - DNA, 2229 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 241 - DNA, 2181 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 242 - DNA, 1062 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaac

SEQ ID NO: 243 - DNA, 2298 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 244 - DNA, 2160 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 245 - DNA, 1635 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 246 - DNA, 2175 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 247 - DNA, 2151 bp, Artificial Sequence
  Synthetic Polynucleotide
atggccttaccagtgaccgccttgctcctgccgctggccttgctgctccacgccgccaggccgggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 248 - DNA, 2802 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 249 - DNA, 2661 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 250 - DNA, 1557 bp, Artificial Sequence
  Synthetic Polynucleotide
atggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 251 - DNA, 2952 bp, Artificial Sequence
  Synthetic Polynucleotide
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 252 - skipped

SEQ ID NO: 253 - DNA, 2181 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 254 - DNA, 2163 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 255 - DNA, 1491 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 256 - DNA, 1512 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 257 - DNA, 1512 bp, Artificial Sequence
  Synthetic Polynucleotide
atggccttaccagtgaccgccttgctcctgccgctggccttgctgctccacgccgccaggccgcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 258 - DNA, 2751 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 259 - DNA, 2571 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 260 - DNA, 2568 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 261 - DNA, 1866 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 262 - DNA, 2541 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 263 - DNA, 1878 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 264 - DNA, 2544 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 265 - DNA, 2703 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 266 - DNA, 2706 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 267 - DNA, 2568 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 268 - DNA, 2814 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 269 - DNA, 2868 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 270 - DNA, 2679 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 271 - DNA, 1890 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 272 - DNA, 2724 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 273 - DNA, 3099 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 274 - DNA, 2454 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 275 - DNA, 2454 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 276 - DNA, 2667 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 277 - DNA, 2790 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 278 - DNA, 2673 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 279 - DNA, 2799 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 280 - DNA, 2472 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 281 - DNA, 1944 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 282 - DNA, 1878 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 283 - DNA, 1878 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 284 - DNA, 1356 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 285 - DNA, 1251 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 286 - DNA, 1281 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 287 - DNA, 1230 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 288 - DNA, 1356 bp, Artificial Sequence
  Synthetic Polynucleotide
atggccttaccagtgaccgccttgctcctgccgctggccttgctgctccacgccgccaggccgcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 289 - DNA, 1251 bp, Artificial Sequence
  Synthetic Polynucleotide
atggccttaccagtgaccgccttgctcctgccgctggccttgctgctccacgccgccaggccgcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 290 - DNA, 1281 bp, Artificial Sequence
  Synthetic Polynucleotide
atggccttaccagtgaccgccttgctcctgccgctggccttgctgctccacgccgccaggccgcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 291 - DNA, 1230 bp, Artificial Sequence
  Synthetic Polynucleotide
atggccttaccagtgaccgccttgctcctgccgctggccttgctgctccacgccgccaggccgcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 292 - DNA, 1932 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 293 - DNA, 2028 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 294 - DNA, 2178 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 295 - DNA, 1620 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 296 - DNA, 927 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 297 - DNA, 1353 bp, Artificial Sequence
  Synthetic Polynucleotide
atggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 298 - DNA, 852 bp, Artificial Sequence
  Synthetic Polynucleotide
atggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 299 - DNA, 1674 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 300 - DNA, 984 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 301 - DNA, 1389 bp, Artificial Sequence
  Synthetic Polynucleotide
atggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 302 - DNA, 891 bp, Artificial Sequence
  Synthetic Polynucleotide
atggactggatttggcgcatccttttccttgtcggcgctgctaccggcgcgcattccttcgaacaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 303 - DNA, 1932 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 304 - DNA, 2028 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 305 - DNA, 2097 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggtctggaggcggaggcagcggcggaggcgggagcggcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 306 - DNA, 1992 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggtctggaggcggaggcagcggcggaggcgggagcggcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 307 - DNA, 2022 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggtctggaggcggaggcagcggcggaggcgggagcggccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaaccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 308 - DNA, 1971 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtgggtctggaggcggaggcagcggcggaggcgggagcggccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 309 - DNA, 1482 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 310 - DNA, 2184 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 311 - DNA, 2166 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 312 - DNA, 1494 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 313 - DNA, 1515 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 314 - DNA, 1515 bp, Artificial Sequence
  Synthetic Polynucleotide
atggccttaccagtgaccgccttgctcctgccgctggccttgctgctccacgccgccaggccgcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttggcggaggcggaagtggaggcggaggatctggcggcggaggctctgacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 315 - DNA, 2754 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 316 - DNA, 2574 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 317 - DNA, 2571 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 318 - DNA, 1869 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 319 - DNA, 2544 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 320 - DNA, 1881 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 321 - DNA, 2547 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 322 - DNA, 2706 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 323 - DNA, 2709 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 324 - DNA, 2571 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 325 - DNA, 2817 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 326 - DNA, 2871 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 327 - DNA, 2682 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 328 - DNA, 1893 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 329 - DNA, 2727 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 330 - DNA, 3102 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 331 - DNA, 2457 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 332 - DNA, 2457 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 333 - DNA, 2670 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 334 - DNA, 2793 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 335 - DNA, 2676 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 336 - DNA, 2802 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 337 - DNA, 2475 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 338 - DNA, 1947 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 339 - DNA, 1881 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 340 - DNA, 1881 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 341 - DNA, 1359 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 342 - DNA, 1254 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 343 - DNA, 1284 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 344 - DNA, 1233 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 345 - DNA, 1359 bp, Artificial Sequence
  Synthetic Polynucleotide
atggccttaccagtgaccgccttgctcctgccgctggccttgctgctccacgccgccaggccgcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttggcggaggcggaagtggaggcggaggatctggcggcggaggctctgacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 346 - DNA, 1254 bp, Artificial Sequence
  Synthetic Polynucleotide
atggccttaccagtgaccgccttgctcctgccgctggccttgctgctccacgccgccaggccgcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttggcggaggcggaagtggaggcggaggatctggcggcggaggctctgacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 347 - DNA, 1284 bp, Artificial Sequence
  Synthetic Polynucleotide
atggccttaccagtgaccgccttgctcctgccgctggccttgctgctccacgccgccaggccgcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttggcggaggcggaagtggaggcggaggatctggcggcggaggctctgacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 348 - DNA, 1233 bp, Artificial Sequence
  Synthetic Polynucleotide
atggccttaccagtgaccgccttgctcctgccgctggccttgctgctccacgccgccaggccgcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttggcggaggcggaagtggaggcggaggatctggcggcggaggctctgacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 349 - DNA, 1935 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 350 - DNA, 2031 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 351 - DNA, 2181 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 352 - DNA, 1635 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 353 - DNA, 942 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 354 - DNA, 1341 bp, Artificial Sequence
  Synthetic Polynucleotide
atggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 355 - DNA, 840 bp, Artificial Sequence
  Synthetic Polynucleotide
atggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 356 - DNA, 1689 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 357 - DNA, 999 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 358 - DNA, 1377 bp, Artificial Sequence
  Synthetic Polynucleotide
atggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 359 - DNA, 879 bp, Artificial Sequence
  Synthetic Polynucleotide
atggactggatttggcgcatccttttccttgtcggcgctgctaccggcgcgcattccttcgaacaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 360 - DNA, 1935 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 361 - DNA, 2031 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 362 - DNA, 2100 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggtctggaggcggaggcagcggcggaggcgggagcggcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 363 - DNA, 1995 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggtctggaggcggaggcagcggcggaggcgggagcggcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 364 - DNA, 2025 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggtctggaggcggaggcagcggcggaggcgggagcggccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaaccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 365 - DNA, 1974 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtgggtctggaggcggaggcagcggcggaggcgggagcggccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 366 - skipped

SEQ ID NO: 367 - DNA, 2211 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 368 - DNA, 2193 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 369 - DNA, 1521 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 370 - DNA, 1542 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 371 - DNA, 1542 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctggcggaggcggaagtggaggcggaggatctggcggcggaggctctgacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 372 - DNA, 2781 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 373 - DNA, 2601 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 374 - DNA, 2598 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 375 - DNA, 1896 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 376 - DNA, 2571 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 377 - DNA, 1908 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 378 - DNA, 2574 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 379 - DNA, 2733 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 380 - DNA, 2736 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 381 - DNA, 2598 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 382 - DNA, 2844 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 383 - DNA, 2898 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 384 - DNA, 2709 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 385 - DNA, 1920 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 386 - DNA, 2754 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 387 - DNA, 3129 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 388 - DNA, 2484 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 389 - DNA, 2484 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 390 - DNA, 2697 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 391 - DNA, 2820 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 392 - DNA, 2703 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 393 - DNA, 2829 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 394 - DNA, 2502 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 395 - DNA, 1974 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 396 - DNA, 1908 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 397 - DNA, 1908 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 398 - DNA, 1386 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 399 - DNA, 1281 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 400 - DNA, 1311 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 401 - DNA, 1260 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 402 - DNA, 1386 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctggcggaggcggaagtggaggcggaggatctggcggcggaggctctgacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 403 - DNA, 1281 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctggcggaggcggaagtggaggcggaggatctggcggcggaggctctgacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 404 - DNA, 1311 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctggcggaggcggaagtggaggcggaggatctggcggcggaggctctgacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 405 - DNA, 1260 bp, Artificial Sequence
  Synthetic Polynucleotide
atggccttaccagtgaccgccttgctcctgccgctggccttgctgctccacgccgccaggccgcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctggcggaggcggaagtggaggcggaggatctggcggcggaggctctgacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 406 - DNA, 1962 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 407 - DNA, 2058 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 408 - DNA, 2208 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 409 - DNA, 1635 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 410 - DNA, 942 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 411 - DNA, 1368 bp, Artificial Sequence
  Synthetic Polynucleotide
atggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 412 - DNA, 867 bp, Artificial Sequence
  Synthetic Polynucleotide
atggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 413 - DNA, 1689 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 414 - DNA, 999 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 415 - DNA, 1404 bp, Artificial Sequence
  Synthetic Polynucleotide
atggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 416 - DNA, 906 bp, Artificial Sequence
  Synthetic Polynucleotide
atggactggatttggcgcatccttttccttgtcggcgctgctaccggcgcgcattccttcgaacaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 417 - DNA, 1962 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 418 - DNA, 2058 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 419 - DNA, 2127 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggtctggaggcggaggcagcggcggaggcgggagcggcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 420 - DNA, 2022 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggtctggaggcggaggcagcggcggaggcgggagcggcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 421 - DNA, 2052 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggtctggaggcggaggcagcggcggaggcgggagcggccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaaccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 422 - DNA, 2001 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtgggtctggaggcggaggcagcggcggaggcgggagcggccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 423 - skipped

SEQ ID NO: 424 - DNA, 2163 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 425 - DNA, 2145 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 426 - DNA, 1473 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctgaaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 427 - DNA, 1494 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 428 - DNA, 1494 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctggcggaggcggaagtggaggcggaggatctggcggcggaggctctgacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 429 - DNA, 2733 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 430 - DNA, 2553 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 431 - DNA, 2550 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 432 - DNA, 1848 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 433 - DNA, 2523 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 434 - DNA, 1860 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 435 - DNA, 2526 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggcgggatccacaccatggctacctacgaggtgctgtgcgaggtggcaagaaagctgggcaccgacgacagagaagtggtgctgttcctgctgaacgtgttcatccctcagcctacactggcccagctgatcggtgcactgagagccctgaaagaggaaggccggctgacctttcctctgctggccgaatgcctgttcagagccggaagaagggatctgctgcgggacctgctgcatctggaccccagatttctggaaagacacctggccggcaccatgagctacttcagcccttaccagctgaccgtgctgcacgttgacggcgaactgtgcgccagagatattcggagcctgatcttcctgagcaaggacaccatcggcagccggtctacccctcagacatttctgcactgggtgtactgcatggaaaacctggacctgctcggccccacagatgtggatgccctgatgtccatgctgagaagcctgagcagagtggacctccagagacaggtgcagacactgatgggactgcacctgagcggacctagccacagccagcactacagacacacccct

SEQ ID NO: 436 - DNA, 2685 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 437 - DNA, 2688 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 438 - DNA, 2550 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 439 - DNA, 2796 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 440 - DNA, 2850 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 441 - DNA, 2661 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 442 - DNA, 1872 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctcagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 443 - DNA, 2706 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 444 - DNA, 3081 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 445 - DNA, 2436 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 446 - DNA, 2436 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 447 - DNA, 2649 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 448 - DNA, 2772 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 449 - DNA, 2655 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 450 - DNA, 2781 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 451 - DNA, 2454 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 452 - DNA, 1926 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 453 - DNA, 1860 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 454 - DNA, 1860 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 455 - DNA, 1338 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 456 - DNA, 1233 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 457 - DNA, 1263 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 458 - DNA, 1212 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 459 - DNA, 1338 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctggcggaggcggaagtggaggcggaggatctggcggcggaggctctgacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatc

SEQ ID NO: 460 - DNA, 1233 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctggcggaggcggaagtggaggcggaggatctggcggcggaggctctgacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaag

SEQ ID NO: 461 - DNA, 1263 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctggcggaggcggaagtggaggcggaggatctggcggcggaggctctgacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaac

SEQ ID NO: 462 - DNA, 1212 bp, Artificial Sequence
  Synthetic Polynucleotide
atggccttaccagtgaccgccttgctcctgccgctggccttgctgctccacgccgccaggccggaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctggcggaggcggaagtggaggcggaggatctggcggcggaggctctgacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 463 - DNA, 1914 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 464 - DNA, 2010 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 465 - DNA, 2160 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 466 - DNA, 1620 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 467 - DNA, 927 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 468 - DNA, 1335 bp, Artificial Sequence
  Synthetic Polynucleotide
atggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 469 - DNA, 834 bp, Artificial Sequence
  Synthetic Polynucleotide
atggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 470 - DNA, 1674 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 471 - DNA, 984 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 472 - DNA, 1371 bp, Artificial Sequence
  Synthetic Polynucleotide
atggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 473 - DNA, 873 bp, Artificial Sequence
  Synthetic Polynucleotide
atggactggatttggcgcatccttttccttgtcggcgctgctaccggcgcgcattccttcgaagaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 474 - DNA, 1914 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 475 - DNA, 2010 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 476 - DNA, 2079 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggtctggaggcggaggcagcggcggaggcgggagcggcgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 477 - DNA, 1974 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggtctggaggcggaggcagcggcggaggcgggagcggcttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagcgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 478 - DNA, 2004 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggtctggaggcggaggcagcggcggaggcgggagcggccagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaaccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 479 - DNA, 1953 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtgggtctggaggcggaggcagcggcggaggcgggagcggccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 480 - skipped

SEQ ID NO: 481 - DNA, 66 bp, Artificial Sequence
  Synthetic Polynucleotide
gtgaagcagaccctgaatttcgacctgctgaagctggctggcgacgtggaatccaacccaggccct

SEQ ID NO: 482 - DNA, 54 bp, Artificial Sequence
  Synthetic Polynucleotide
gagggcagaggaagtctactaacctgcggagatgtggaagaaaatcctggccca

SEQ ID NO: 483 - DNA, 57 bp, Artificial Sequence
  Synthetic Polynucleotide
gcaacaaacttctcactactcaaacaagcaggtgacgtggaggagaatcccgggcct

SEQ ID NO: 484 - DNA, 60 bp, Artificial Sequence
  Synthetic Polynucleotide
caatgcactaattacgcattgctcaagctggccggtgacgttgagagtaatcctggcccc

SEQ ID NO: 485 - DNA, 12 bp, Artificial Sequence
  Synthetic Polynucleotide
agcggatctggc

SEQ ID NO: 486 - DNA, 12 bp, Artificial Sequence
  Synthetic Polynucleotide
cgggccaagaga

SEQ ID NO: 487 - DNA, 12 bp, Artificial Sequence
  Synthetic Polynucleotide
agggccaagcga

SEQ ID NO: 488 - DNA, 12 bp, Artificial Sequence
  Synthetic Polynucleotide
cgcgccaagaga

SEQ ID NO: 489-490 - skipped (2 entries)

SEQ ID NO: 491 - protein, 544 aa, Artificial Sequence
  Synthetic Polypeptide
MADKNILYGPEPFYPLEDGTAGEQMFDALSRYAAIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNEDLGGYQCLNNFISQNSDSNLDVKKFKPYSFNRDDQVASIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPLHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVKFLDEIPKGSTGKIDRKVLRQMLEKHTNG

SEQ ID NO: 492 - protein, 544 aa, Artificial Sequence
  Synthetic Polypeptide
MADKNILYGPEPFYPLEDGTAGEQMFDALSRYADIPGCIALTNAHTKENVLYEEFLKLSCRLAESFKKYGLKQNDTIAVCSENSLQFFLPVIASLYLGIIVAPVNDKYIERELIHSLGIVKPRIVFCSKNTFQKVLNVKSKLKSIETIIILDLNDDLGGYQCLNNFISQNSDSNLDVKKFKPYSFNRDDQVALIMFSSGTTGLPKGVMLTHKNIVARFSIAKDPTFGNAINPTSAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDAKPGSTGKIVPFHAVKVVDPTTGKILGPNEPGELYFKGPMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDYVASQVSTAKWLRGGVIFLDEIPKGSTGKIDRKVLRQMLEKHTNG

SEQ ID NO: 493 - protein, 544 aa, Artificial Sequence
  Synthetic Polypeptide
MADKNILYGPEPFYPLADGTAGEQMFDALSRYADISGCIALTNAHTKENVLYEEFLKLSCRLAESFKKYGLKQNDTIAVCSENGLQFFLPVIASLYLGIIAAPVSDKYIERELIHSLGIVKPRIIFCSKNTFQKVLNVKSKLKSVETIIILDLNEDLGGYQCLNNFISQNSDSNLDVKKFKPYSFNRDDQVALVMFSSGTTGVPKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPKGDARPGSTGKIVPFHAVKVVDPTTGKILGPNEPGELYFKGAMIMKGYYNNEEATKAIIDNDGWLRSGDIAYYDNDGHFYIVDRLKSLIKYKGYQVAPAEIEGILLQHPYIVDAGVTGIPDEAAGELPAAGVVVQTGKYLNEQIVQDFVSSQVSTAKWLRGGVKFLDEIPKGSTGKIDRKVLRQMFEKHTNG

SEQ ID NO: 494 - protein, 544 aa, Artificial Sequence
  Synthetic Polypeptide
MADKNILYGPEPFYPLADGTAGEQMFYALSRYADISGCIALTNAHTKENVLYEEFLKLSCRLAESFKKYGLKQNDTIAVCSENGLQFFLPIIASLYLGIIAAPVSDKYIERELIHSLGIVKPRIIFCSKNTFQKVLNVKSKLKYVETIIILDLNEDLGGYQCLNNFISQNSDINLDVKKFKPYSFNRDDQVALVMFSSGTTGVSKGVMLTHKNIVARFSLAKDPTFGNAINPTTAILTVIPFHHGFGMMTTLGYFTCGFRVVLMHTFEEKLFLQSLQDYKVESTLLVPTLMAFLAKSALVEKYDLSHLKEIASGGAPLSKEIGEMVKKRFKLNFVRQGYGLTETTSAVLITPNNDVRPGSTGKIVPFHAVKVVDPTTGKILGPNEPGELYFKGDMIMKGYYNNEEATKAIINKDGWLRSGDIAYYDNDGHFYIVDRLKSLIKYKGYQVAPAEIEGILLQHPYIVDAGVTGIPDEAAGELPAAGVVVQTGKYLNEQIVQNFVSSQVSTAKWLRGGVKFLDEIPKGSTGKIDRKVLRQMFEKHTNG

SEQ ID NO: 495 - protein, 542 aa, Artificial Sequence
  Synthetic Polypeptide
MMKREKNVIYGPEPLHPLEDLTAGEMLFRALRKHSHLPQALVDVVGDESLSYKEFFEATVLLAQSLHNCGYKMNDVVSICAENNTRFFIPVIAAWYIGMIVAPVNESYIPDELCKVMGISKPQIVFTTKNILNKVLEVQSRTNFIKRIIILDTVENIHGCESLPNGISRYSDGNIANFKPLHFDPVEQVAAILCSSGTTGLPKGVMQTHQNICVRLIHALDPRAGTQLIPGVTVLVYLPFFHAFGFSITLGYFMVGLRVIMFRRFDQEAFLKAIQDYEVRSVINVPSVILFLSKSPLVDKYDLSSLRELCCGAAPLAKEVAEVAAKRLNLPGIRCGFGLTESTSANIHSLRDEFKSGSLGRVTPLMAAKIADRETGKALGPNQVGELCIKGPMVSKGYVNNVEATKEAIDDDGWLHSGDFGYYDEDEHFYVVDRYKELIKYKGSQVAPAELEEILLKNPCIRDVAVVGIPDLEAGELPSAFVVKQPGKEITAKEVYDYLAERVSHTKYLRGGVRFVDSIPRNVTGKITRKELLKQLLEKAGG

SEQ ID NO: 496 - protein, 168 aa, Artificial Sequence
  Synthetic Polypeptide
KPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGD

SEQ ID NO: 497 - protein, 170 aa, Artificial Sequence
  Synthetic Polypeptide
VFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILA

SEQ ID NO: 498 - protein, 147 aa, Artificial Sequence
  Synthetic Polypeptide
EAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGD

SEQ ID NO: 499 - protein, 152 aa, Artificial Sequence
  Synthetic Polypeptide
NPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDR

SEQ ID NO: 500 - protein, 205 aa, Artificial Sequence
  Synthetic Polypeptide
LPASPTDRSIVLDNGYVCSWEGIPDDLRDCPKTEDMSKQHGAALKLPPDVLDEMECNAKKSGCVRGCLQCLALIKCTAKMRKYIPGRCHSYEGDKDIAQGGIGKELTIDIPEIPGFLDLAPMDQFVAQVDLCVDCSSRCLKGLANVQCSCKLYKWLPTRCTGFQAKIKKEADTVIGLEDALALGFDTIQACVAAGKCKDTVGRYS

SEQ ID NO: 501 - protein, 168 aa, Artificial Sequence
  Synthetic Polypeptide
AASEEADDDHVSLVKNYWRIGVGNERDVSLDRGGPPKLSKELLAEMHAIASNAGCSRVCLIGLSKIKCTPKMKTFLPGRCNTFAPKPATGDGPFAAAAAIPGFSDLTAMEQYKAQVAQCDCSNRCLVGLANIKCSAALKAALPQRCTTFATNIQKEGEVDSIKGYGRK

SEQ ID NO: 502 - protein, 194 aa, Artificial Sequence
  Synthetic Polypeptide
QPTENKQESQIEDIDRSTSLGLMCYEQCTGQSGLDLKCYKECADFTGDRNRGRKLPGKKLPLEVLKIMEANARRAGCTRGCLICLSKIKCTAKMKQYIPGRCHTYEGDKSIGQGGIGGPIVDIPEIIGFQNMEPMEQFIAQVDLCADCTTGCLKGLANVRCNDLLKKWLPDRCAGFANKIQSEVDNIKGLAGDR

SEQ ID NO: 503 - protein, 169 aa, Artificial Sequence
  Synthetic Polypeptide
KSIDSYENIDIVAVAGNFAAVDQDANRGGNLPGKKMPIEVLKEMEANAKRAGCVRGCLICLSHIKCTAKMKKFIPGRCHSYHGDADTKQGALEEVVDMPEIPGFVDMEPMEQFIAQVDKCEDCTTGCLKGLANVHCSDLLKKWLPQRCSQFADKIQSEVDTIKGLAGDR

SEQ ID NO: 504 - protein, 192 aa, Artificial Sequence
  Synthetic Polypeptide
NPTENKDDIDIVGVEGKFGTTDLETDLFTIVEDMNVISRDTNLANSDADRGKMPGKKLPLEVLIEMEANARKAGCTRGCLICLSKIKCTAKMKVYIPGRCHDYGGDKKTGQAGIVGAIVDIPEISGFKELGPMEQFIAQVDLCADCTTGCLKGLANVKCSALLKKWLPDRCASFADKIQSEVDNIKGLAGDR

SEQ ID NO: 505 - protein, 169 aa, Artificial Sequence
  Synthetic Polypeptide
KPTENNDDIDIVGIASTFITTNTDADRGKMPGKKLPLAVLKEMEANAAKAGCSRGCLICLSKIKCTAKMKQFIPGRCHDYGGDKKTGQAALVGAIFDIPEIFGFLDMEPIEQFIAQVDLCAGCTTGCLKGLANIKCSELLKKWLPKRCTSFAYKMQKEMHNIKGMAGDR

SEQ ID NO: 506 - protein, 169 aa, Artificial Sequence
  Synthetic Polypeptide
KATENNDDIDIVGIASTFITTNTDADRGKMPGKRLPLAVLKEMEANAVKAGCSRGCLICLSKIKCTAKMKQYIPGRCHDYGGDKKTGQAAIEGAIDDIPEISGFKEMAPMEQFIAQVDLCADCTTGCLKGLANVKCSELLKKWLPKRCTSFATKMQKEIHNIKGMGGDR

SEQ ID NO: 507 - protein, 195 aa, Artificial Sequence
  Synthetic Polypeptide
NPTETQDGVDILGVEGKFGTETNLETDLFTIWEINGIIKSDRDTNRANADADRGKMPGKKLPLAVLIEMEANAFKAGCTRGCLICLSKIKCTAKMKEYIPGRCHDYGGDKKTGQAGIVGAIVDIPEISGFKELGPMEQFIAQVDLCADCTTGCLKGLANVKCSALLKKWLPDRCASFADKIQSEVHNIKGLAGDR

SEQ ID NO: 508 - protein, 173 aa, Artificial Sequence
  Synthetic Polypeptide
ATINENFEDIDLVAIGGSFATDVDANRGGHGGHPGKKMPKEVLLEMEANAKRAGCHRGCLICLSHIKCTQKMKKFIPGRCHSYAGDKDSAQGGITEEETVDMPEIAGFKDLEPMEQFIAQVDLCVDCTTGCLKGLANVHCSDLLKKWLPSRCKTFASKIQSQVDTIKGLAGDR

SEQ ID NO: 509 - protein, 192 aa, Artificial Sequence
  Synthetic Polypeptide
NPTENNDHINIVGIEGKFGITDLETDLFTIWETNRMISTDNEQANTDSNRGKMPGKKLPLAVLIEMEANAFKAGCTRGCLICLSKIKCTAKMKKYIPGRCHDYGGDKKTGQAGIVGAIVDIPDISGFKEMGPMEQFIAQVDRCTDCTTGCLKGLANVKCSELLKKWLPDRCASFADKIQSEVHNIKGLAGDR

SEQ ID NO: 510 - protein, 165 aa, Artificial Sequence
  Synthetic Polypeptide
QPTENKKESYTEDTDVNGDHDRGRKLPGKKLPLEVLKIMEANARRAGCTRGCLICLSKIKCTAKMKQYIPGRCHTYEGDKSIGQAGIGGPIIDIPEIIGFKNMEPMEQFIAQVDLCADCTTGCLKGLANVRCNDLLKKWLPDRCAGFALKIQGEVENIKGMAGDR

SEQ ID NO: 511 - protein, 205 aa, Artificial Sequence; identical to SEQ ID NO: 500
  Synthetic Polypeptide

SEQ ID NO: 512 - protein, 177 aa, Artificial Sequence
  Synthetic Polypeptide
WAASEEADDDLVSLVKNYWGVGVSNERDVSLDRGGHGKLPKKLSVEILAEMEANAQKSNCSRGCLIGLSKIKCTPKMKKFLPGRCHEYSGDPKTGQGPLTAAAVIPGYSDLTAMEQFKLQVDKCDCSTQCLKGLANVKCSAALKAVLPTRCSQFATQIQAEVGTIKGKGKKPTPPIG

SEQ ID NO: 513 - protein, 310 aa, Artificial Sequence
  Synthetic Polypeptide
ASKVYDPEQRKRMITGPQWWARCKQMNVLDSFINYYDSEKHAENAVIFLHGNAASSYLWRHVVPHIEPVARCIIPDLIGMGKSGKSGNGSYRLLDHYKYLTAWFELLNLPKKIIFVGHDWGACLAFHYSYEHQDKIKAIVHAESVVDVIESWDEWPDIEEDIALIKSEEGEKMVLENNFFVETMLPSKIMRKLEPEEFAAYLEPFKEKGEVRRPTLSWPREIPLVKGGKPDVVQIVRNYNAYLRASDDLPKMFIESDPGFFSNAIVEGAKKFPNTEFVKVKGLHFSQEDAPDEMGKYIKSFVERVLKNEQ

SEQ ID NO: 514 - protein, 10 aa, Artificial Sequence
  Synthetic Polypeptide
GGGGGGGGGG

SEQ ID NO: 515 - protein, 21 aa, Artificial Sequence
  Synthetic Polypeptide
MALPVTALLLPLALLLHAARP

SEQ ID NO: 516 - protein, 21 aa, Artificial Sequence
  Synthetic Polypeptide
MALPVTALLLPLALLLHAARP

SEQ ID NO: 517 - protein, 19 aa, Artificial Sequence
  Synthetic Polypeptide
MDWIWRILFLVGAATGAHS

SEQ ID NO: 518 - protein, 19 aa, Artificial Sequence
  Synthetic Polypeptide
MDWIWRILFLVGAATGAHS

SEQ ID NO: 519 - protein, 20 aa, Artificial Sequence
  Synthetic Polypeptide
MACPGFLWALVISTCLEFSM

SEQ ID NO: 520 - protein, 19 aa, Artificial Sequence
  Synthetic Polypeptide
MTIRLLCYMGFYFLGAGLM

SEQ ID NO: 521 - protein, 15 aa, Artificial Sequence
  Synthetic Polypeptide
GGGGSGGGGSGGGGS

SEQ ID NO: 522 - protein, 15 aa, Artificial Sequence
  Synthetic Polypeptide
GGGGSGGGGSGGGGS

SEQ ID NO: 523 - protein, 15 aa, Artificial Sequence
  Synthetic Polypeptide
GGGGSGGGGSGGGGS

SEQ ID NO: 524 - protein, 15 aa, Artificial Sequence
  Synthetic Polypeptide
GGGGSGGGGSGGGGS

SEQ ID NO: 525 - protein, 15 aa, Artificial Sequence
  Synthetic Polypeptide
GGGGSGGGGSGGGGS

SEQ ID NO: 526 - protein, 15 aa, Artificial Sequence
  Synthetic Polypeptide
GGGGSGGGGSGGGGS

SEQ ID NO: 527 - protein, 35 aa, Artificial Sequence
  Synthetic Polypeptide
GGSGSGGGGSGGGGSGSGGSGSGGSGSGGSGSGGS

SEQ ID NO: 528 - protein, 35 aa, Artificial Sequence
  Synthetic Polypeptide
GGGGSGGGGSGGGGSGSGGSGSGGSGSGGSGSGGS

SEQ ID NO: 529 - protein, 25 aa, Artificial Sequence
  Synthetic Polypeptide
SSADDAKKDAAKKDDAKKDDAKKDG

SEQ ID NO: 530 - protein, 9 aa, Artificial Sequence
  Synthetic Polypeptide
GGGGGGGGG

SEQ ID NO: 531 - protein, 6 aa, Artificial Sequence
  Synthetic Polypeptide
SGGGGS

SEQ ID NO: 532 - protein, 8 aa, Artificial Sequence
  Synthetic Polypeptide
GGGSGGGS

SEQ ID NO: 533 - protein, 10 aa, Artificial Sequence
  Synthetic Polypeptide
GGGGSGGGGS

SEQ ID NO: 534 - protein, 15 aa, Artificial Sequence
  Synthetic Polypeptide
GGGGSGGGGSGGGGS

SEQ ID NO: 535 - protein, 12 aa, Artificial Sequence
  Synthetic Polypeptide
EQKLISEEDGSG

SEQ ID NO: 536 - protein, 13 aa, Artificial Sequence
  Synthetic Polypeptide
EQKLISEEDLGSG

SEQ ID NO: 537 - protein, 13 aa, Artificial Sequence
  Synthetic Polypeptide
EQKLISEEDLGSG

SEQ ID NO: 538 - protein, 17 aa, Artificial Sequence
  Synthetic Polypeptide
GKPIPNPLLGLDSTGSG

SEQ ID NO: 539 - protein, 12 aa, Artificial Sequence
  Synthetic Polypeptide
YPYDVPDYAGSG

SEQ ID NO: 540 - protein, 9 aa, Artificial Sequence
  Synthetic Polypeptide
HHHHHHGSG

SEQ ID NO: 541 - protein, 15 aa, Artificial Sequence
  Synthetic Polypeptide
GLNDIFEAQKIEWHE

SEQ ID NO: 542 - protein, 13 aa, Artificial Sequence
  Synthetic Polypeptide
GSGGGGSGGGGSG

SEQ ID NO: 543 - protein, 13 aa, Artificial Sequence
  Synthetic Polypeptide
GSGGGGSGGGGSG

SEQ ID NO: 544 - protein, 11 aa, Artificial Sequence
  Synthetic Polypeptide
WSHPQFEKGSG

SEQ ID NO: 545 - protein, 11 aa, Artificial Sequence
  Synthetic Polypeptide
WSHPQFEKGSG

SEQ ID NO: 546 - protein, 11 aa, Artificial Sequence
  Synthetic Polypeptide
DYKDDDDKGQR

SEQ ID NO: 547 - protein, 10 aa, Artificial Sequence
  Synthetic Polypeptide
GGGGGGGGGG

SEQ ID NO: 548 - protein, 141 aa, Artificial Sequence
  Synthetic Polypeptide
DIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 549 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 550 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 551 - protein, 140 aa, Artificial Sequence; identical to SEQ ID NO: 549
  Synthetic Polypeptide

SEQ ID NO: 552 - protein, 137 aa, Artificial Sequence
  Synthetic Polypeptide
PDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 553 - protein, 140 aa, Artificial Sequence
  Synthetic Polypeptide
IQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 554 - protein, 137 aa, Artificial Sequence
  Synthetic Polypeptide
PDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 555 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSS

SEQ ID NO: 556 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSPESSCDVKLVEKSFETDTNLNFQNLSVIGFRILLLKVAGFNLLMTLRLWSS

SEQ ID NO: 557 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNRAVAWSNKSDFACANAFNNSIIPEDTFFPSSDVPCDVKLVEKSFETDTNLNFQNLSVIGFRILLLKVAGFNLLMTLRLWSS

SEQ ID NO: 558 - protein, 140 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSSDSSCDVKLVEKSFETDTNLNFQNLSVIGFRILLLKVAGFNLLMTLRLWSS

SEQ ID NO: 559 - protein, 239 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 560 - protein, 136 aa, Artificial Sequence
  Synthetic Polypeptide
IQNPEPAVYQLKDPRSQDSTLCLFTDFDSQINVPKTMESGTFITDKTVLDMKAMDSKSNGAIAWSNQTSFTCQDIFKETNATYPSSDVPCDATLTEKSFETDMNLNFQNLSVMGLRILLLKVAGFNLLMTLRLWSS

SEQ ID NO: 561 - protein, 133 aa, Artificial Sequence
  Synthetic Polypeptide
VQDPDPSVYQMRSPKTGRTVCLFTDFDSQADFQKPEGATVISLNSTVLDMKVMDSKSNGALTWNSETNIECKENFQQPFYPSSNYSCDAKLIEKSFETDMDLNFYNLLVIGLRILLLKVIGFNLFMTLRLWSC

SEQ ID NO: 562 - protein, 177 aa, Artificial Sequence
  Synthetic Polypeptide
EDLNKVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSVSYQQGVLSATILYEILLGKATLYAVLVSALVLMAMVKRKDF

SEQ ID NO: 563 - protein, 179 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 564 - protein, 179 aa, Artificial Sequence; identical to SEQ ID NO: 563
  Synthetic Polypeptide

SEQ ID NO: 565 - protein, 179 aa, Artificial Sequence
  Synthetic Polypeptide
EDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 566 - protein, 179 aa, Artificial Sequence
  Synthetic Polypeptide
EDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 567 - protein, 179 aa, Artificial Sequence; identical to SEQ ID NO: 563
  Synthetic Polypeptide

SEQ ID NO: 568 - protein, 178 aa, Artificial Sequence
  Synthetic Polypeptide
DLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 569 - protein, 177 aa, Artificial Sequence
  Synthetic Polypeptide
EDLKNVFPPEVAVFEPSEAEISHTQKATLVCLATGFFPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDF

SEQ ID NO: 570 - protein, 177 aa, Artificial Sequence; identical to SEQ ID NO: 562
  Synthetic Polypeptide

SEQ ID NO: 571 - protein, 179 aa, Artificial Sequence
  Synthetic Polypeptide
EDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 572 - protein, 179 aa, Artificial Sequence
  Synthetic Polypeptide
EDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 573 - protein, 179 aa, Artificial Sequence
  Synthetic Polypeptide
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSESYQQGVLSATILYEILLGKATLYAVLVSALVLMAMVKRKDSRG

SEQ ID NO: 574 - protein, 179 aa, Artificial Sequence
  Synthetic Polypeptide
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSASYQQGVLSATILYEILLGKATLYAVLVSALVLMAMVKRKDSRG

SEQ ID NO: 575 - protein, 179 aa, Artificial Sequence
  Synthetic Polypeptide
EDLKNVFPPEVAVFEPSKAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYHQGVLSATILYEILLGKATLYAVLVSALVLMAMVKRKDSRG

SEQ ID NO: 576 - protein, 179 aa, Artificial Sequence
  Synthetic Polypeptide
EDLKNVFPPEVAVFEPSRAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 577 - protein, 179 aa, Artificial Sequence
  Synthetic Polypeptide
EDLKNVFPPEVAVFEPSRAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 578 - protein, 179 aa, Artificial Sequence
  Synthetic Polypeptide
EDLKNVFPPEVAVFEPSKAEIAHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGITSASYHQGVLSATILYEILLGKATLYAVLVSALVLMAMVKRKDSRG

SEQ ID NO: 579 - protein, 179 aa, Artificial Sequence
  Synthetic Polypeptide
EDLKNVFPPEVAVFEPSKAEIAHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 580 - protein, 179 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSGLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 581 - protein, 171 aa, Artificial Sequence
  Synthetic Polypeptide
EDLRNVTPPKVSLFEPSKAEIANKQKATLVCLARGFFPDHVELSWWVNGKEVHSGVSTDPQAYKESNYSYCLSSRLRVSATFWHNPRNHFRCQVQFHGLSEEDKWPEGSPKPVTQNISAEAWGRACGITSSYQQGVLSATILYEILLGKATLYAVLVSTLVVMAMVKRKNS

SEQ ID NO: 582 - protein, 177 aa, Artificial Sequence
  Synthetic Polypeptide
EDLQKVTPPTVTVFEPSEAEISRTQKATLVCLARGFYPDHVELSWWVNGKEVTSGFSTDPQPDKERPSENDSSYCLSSRLRVSASFWHNPRNHFRCQVQFYGLGDDDEWKYDRVKPITQNISAEAWGRADCGFTSVSYHQGVLSATILYEILLGKATLYAVLVSILVLMAKVKRKGS

SEQ ID NO: 583 - protein, 276 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 584 - protein, 269 aa, Artificial Sequence
  Synthetic Polypeptide
GCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSRLRAPSSSLGAFFAGDLPPPLQAGAA

SEQ ID NO: 585 - protein, 258 aa, Artificial Sequence
  Synthetic Polypeptide
TPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 586 - protein, 210 aa, Artificial Sequence
  Synthetic Polypeptide
TPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPV

SEQ ID NO: 587 - protein, 189 aa, Artificial Sequence
  Synthetic Polypeptide
DKQLDADVSPKPTIFLPSIAETKLQKAGTYLCLLEKFFPDIIKIHWQEKKSNTILGSQEGNTMKTNDTYMKFSWLTVPEESLDKEHRCIVRHENNKNGIDQEIIFPPIKTDVTTVDPKYNYSKDANDVITMDPKDNWSKDANDTLLLQLTNTSAYYMYLLLLLKSVVYFAIITCCLLGRTAFCCNGEKS

SEQ ID NO: 588 - protein, 173 aa, Artificial Sequence
  Synthetic Polypeptide
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 589 - protein, 153 aa, Artificial Sequence
  Synthetic Polypeptide
SQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFL

SEQ ID NO: 590 - protein, 153 aa, Artificial Sequence; identical to SEQ ID NO: 589
  Synthetic Polypeptide

SEQ ID NO: 591 - protein, 107 aa, Artificial Sequence
  Synthetic Polypeptide
IQNPDPAVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 592 - protein, 179 aa, Artificial Sequence
  Synthetic Polypeptide
EDLKNVFPPEVAVFEPSRAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 593 - protein, 179 aa, Artificial Sequence
  Synthetic Polypeptide
EDLKNVFPPEVAVFEPSRAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 594 - protein, 30 aa, Artificial Sequence
  Synthetic Polypeptide
QSFGLLDPKLCYLLDGILFIYGVILTALFL

SEQ ID NO: 595 - protein, 143 aa, Artificial Sequence
  Synthetic Polypeptide
QSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 596 - protein, 143 aa, Artificial Sequence; identical to SEQ ID NO: 595
  Synthetic Polypeptide

SEQ ID NO: 597 - protein, 41 aa, Artificial Sequence
  Synthetic Polypeptide
RSKRSRLLHSDYMNMTPRRPGPTRKHYQPYAPPRDFAAYRS

SEQ ID NO: 598 - protein, 42 aa, Artificial Sequence
  Synthetic Polypeptide
KRGRKKLLYIFKQPFMRPVQTTQEEDGCSCRFPEEEEGGCEL

SEQ ID NO: 599 - protein, 55 aa, Artificial Sequence
  Synthetic Polypeptide
KNRKAKAKPVTRGAGAGGRQRGQNKERPPPVPNPDYEPIRKGQRDLYSGLNQRRI

SEQ ID NO: 600 - protein, 30 aa, Artificial Sequence; identical to SEQ ID NO: 594
  Synthetic Polypeptide

SEQ ID NO: 601 - protein, 113 aa, Artificial Sequence
  Synthetic Polypeptide
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 602 - protein, 143 aa, Artificial Sequence; identical to SEQ ID NO: 595
  Synthetic Polypeptide

SEQ ID NO: 603 - protein, 41 aa, Artificial Sequence; identical to SEQ ID NO: 597
  Synthetic Polypeptide

SEQ ID NO: 604 - protein, 42 aa, Artificial Sequence; identical to SEQ ID NO: 598
  Synthetic Polypeptide

SEQ ID NO: 605 - protein, 184 aa, Artificial Sequence
  Synthetic Polypeptide
QSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 606 - protein, 185 aa, Artificial Sequence
  Synthetic Polypeptide
QSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 607 - protein, 184 aa, Artificial Sequence; identical to SEQ ID NO: 605
  Synthetic Polypeptide

SEQ ID NO: 608 - protein, 185 aa, Artificial Sequence; identical to SEQ ID NO: 606
  Synthetic Polypeptide

SEQ ID NO: 609 - protein, 60 aa, Artificial Sequence
  Synthetic Polypeptide
IPEDTFFPSPESSCDVKLVEKSFETDTNLNFQNLSVIGFRILLLKVAGFNLLMTLRLWSS

SEQ ID NO: 610 - protein, 53 aa, Artificial Sequence
  Synthetic Polypeptide
GRADCGFTSESYQQGVLSATILYEILLGKATLYAVLVSALVLMAMVKRKDSRG

SEQ ID NO: 611 - protein, 67 aa, Artificial Sequence
  Synthetic Polypeptide
PIKTDVITMDPKDNCSKDANDTLLLQLTNTSAYYMYLLLLLKSVVYFAIITCCLLRRTAFCCNGEKS

SEQ ID NO: 612 - protein, 68 aa, Artificial Sequence
  Synthetic Polypeptide
EVKTDSTDHVKPKETENTKQPSKSCHKPKAIVHTEKVNMMSLTVLGLRMLFAKTVAVNFLLTAKLFFL

SEQ ID NO: 613 - protein, 106 aa, Artificial Sequence
  Synthetic Polypeptide
GQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 614 - protein, 103 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 615 - protein, 102 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKS

SEQ ID NO: 616 - protein, 113 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCP

SEQ ID NO: 617 - protein, 103 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 618 - protein, 102 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 619 - protein, 113 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCP

SEQ ID NO: 620 - protein, 101 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERK

SEQ ID NO: 621 - protein, 102 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKC

SEQ ID NO: 622 - protein, 103 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCC

SEQ ID NO: 623 - protein, 103 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG

SEQ ID NO: 624 - protein, 121 aa, Artificial Sequence
  Synthetic Polypeptide
ASPTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPS

SEQ ID NO: 625 - protein, 108 aa, Artificial Sequence
  Synthetic Polypeptide
ASPTSPKVFPLSLDSTPQDGNVVVACLVQGFFPQEPLSVTWSESGQNVTARNFPPSQDASGDLYTTSSQLTLPATQCPDGKSVTCHVKHYTNPSQDVTVPCPVPPPPP

SEQ ID NO: 626 - protein, 159 aa, Artificial Sequence
  Synthetic Polypeptide
APTKAPDVFPIISGCRHPKDNSPVVLACLITGYHPTSVTVTWYMGTQSQPQRTFPEIQRRDSYYMTSSQLSTPLQQWRQGEYKCVVQHTASKSKKEIFRWPESPKAQASSVPTAQPQAEGSLAKATTAPATTRNTGRGGEEKKKEKEKEEQEERETKTP

SEQ ID NO: 627 - protein, 103 aa, Artificial Sequence
  Synthetic Polypeptide
ASTQSPSVFPLTRCCKNIPSNATSVTLGCLATGYFPEPVMVTWDTGSLNGTTMTLPATTLTLSGHYATISLLTVSGAWAKQMFTCRVAHTPSSTDWVDNKTFS

SEQ ID NO: 628 - protein, 104 aa, Artificial Sequence
  Synthetic Polypeptide
GSASAPTLFPLVSCENSPSDTSSVAVGCLAQDFLPDSITLSWKYKNNSDISSTRGFPSVLRGGKYAATSQVLLPSKDVMQGTDEHVVCKVQHPNGNKEKNVPLP

SEQ ID NO: 629 - protein, 94 aa, Artificial Sequence
  Synthetic Polypeptide
IQNPDPAVYQLRDSKSSDKSVCLFTDFDSQTNVSQSKDSDVYITDKTVLDMRSMDFKSNSAVAWSNKSDFACANAFNNSIIPEDTFFPSPESSC

SEQ ID NO: 630 - protein, 126 aa, Artificial Sequence
  Synthetic Polypeptide
EDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAW

SEQ ID NO: 631 - protein, 114 aa, Artificial Sequence
  Synthetic Polypeptide
DKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVIT

SEQ ID NO: 632 - protein, 92 aa, Artificial Sequence
  Synthetic Polypeptide
SQPHTKPSVFVMKNGTNVACLVKEFYPKDIRINLVSSKKITEFDPAIVISPSGKYNAVKLGKYEDSNSVTCSVQHDNKTVHSTDFEVKTDST

SEQ ID NO: 633 - protein, 21 aa, Artificial Sequence
  Synthetic Polypeptide
DVKLVEKSFETDTNLNFQNLS

SEQ ID NO: 634 - protein, 19 aa, Artificial Sequence
  Synthetic Polypeptide
GRADCGFTSESYQQGVLSA

SEQ ID NO: 635 - protein, 24 aa, Artificial Sequence
  Synthetic Polypeptide
MDPKDNCSKDANDTLLLQLTNTSA

SEQ ID NO: 636 - protein, 44 aa, Artificial Sequence
  Synthetic Polypeptide
EVKTDSTDHVKPKETENTKQPSKSCHKPKAIVHTEKVNMMSLTV

SEQ ID NO: 637 - protein, 20 aa, Artificial Sequence
  Synthetic Polypeptide
VIGFRILLLKVAGFNLLMTL

SEQ ID NO: 638 - protein, 23 aa, Artificial Sequence
  Synthetic Polypeptide
TILYEILLGKATLYAVLVSALVL

SEQ ID NO: 639 - protein, 23 aa, Artificial Sequence
  Synthetic Polypeptide
YYMYLLLLLKSVVYFAIITCCLL

SEQ ID NO: 640 - protein, 23 aa, Artificial Sequence
  Synthetic Polypeptide
LGLRMLFAKTVAVNFLLTAKLFF

SEQ ID NO: 641 - protein, 10 aa, Artificial Sequence
  Synthetic Polypeptide
DKTHTCPPCP

SEQ ID NO: 642 - protein, 9 aa, Artificial Sequence
  Synthetic Polypeptide
CCVECPPCP

SEQ ID NO: 643 - protein, 234 aa, Artificial Sequence
  Synthetic Polypeptide
PAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKK

SEQ ID NO: 644 - protein, 235 aa, Artificial Sequence
  Synthetic Polypeptide
PAEPKSPDKTHTCPPCPAPPVAGPSVFLFPPKPKDTLMIARTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSSLSPGKK

SEQ ID NO: 645 - protein, 229 aa, Artificial Sequence
  Synthetic Polypeptide
ESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 646 - protein, 119 aa, Artificial Sequence
  Synthetic Polypeptide
ESKYGPPCPPCPGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 647 - protein, 12 aa, Artificial Sequence
  Synthetic Polypeptide
ESKYGPPCPPCP

SEQ ID NO: 648 - protein, 112 aa, Artificial Sequence
  Synthetic Polypeptide
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 649 - protein, 112 aa, Artificial Sequence; identical to SEQ ID NO: 648
  Synthetic Polypeptide

SEQ ID NO: 650 - protein, 42 aa, Artificial Sequence; identical to SEQ ID NO: 598
  Synthetic Polypeptide

SEQ ID NO: 651 - protein, 72 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYC

SEQ ID NO: 652 - protein, 226 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 653 - protein, 114 aa, Artificial Sequence
  Synthetic Polypeptide
AKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCEL

SEQ ID NO: 654 - protein, 108 aa, Artificial Sequence
  Synthetic Polypeptide
KIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 655 - protein, 150 aa, Artificial Sequence
  Synthetic Polypeptide
FKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 656 - protein, 185 aa, Artificial Sequence
  Synthetic Polypeptide
DGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVQNPDYEPIRKGQRDLYSGLNQRRI

SEQ ID NO: 657 - protein, 160 aa, Artificial Sequence
  Synthetic Polypeptide
QSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 658 - protein, 143 aa, Artificial Sequence; identical to SEQ ID NO: 595
  Synthetic Polypeptide

SEQ ID NO: 659 - protein, 6 aa, Artificial Sequence
  Synthetic Polypeptide
GGGGGG

SEQ ID NO: 660 - protein, 199 aa, Artificial Sequence
  Synthetic Polypeptide
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 661 - protein, 132 aa, Artificial Sequence
  Synthetic Polypeptide
MAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 662 - protein, 172 aa, Artificial Sequence
  Synthetic Polypeptide
MGNEASYPLEMCSHFDADEIKRLGKRFKKLDLDNSGSLSVEEFMSLPELQQNPLVQRVIDIFDTDGNGEVDFKEFIEGVSQFSVKGDKEQKLRFAFRIYDMDKDGYISNGELFQVLKMMVGNNTKLADTQLQQIVDKTIINADKDGDGRISFEEFCAVVGGLDIHKKMVVDV

SEQ ID NO: 663 - protein, 357 aa, Artificial Sequence
  Synthetic Polypeptide
MLLLVTSLLLCELPHPAFLLIPRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFM

SEQ ID NO: 664 - protein, 424 aa, Artificial Sequence
  Synthetic Polypeptide
MRPSGTAGAAFLALLAALCPASRALEEKKGNYVVTDHGSCVRACGADSYEMEEDGVRKCKKCEGPCRKVCNGIGIGEFKDSLSINATNIKHFKNCTSISGDLHILPVAFRGDSFTHTPPLDPQELDILKTVKEITGFLLIQAWPENRTDLHAFENLEIIRGRTKQHGQFSLAVVSLNITSLGLRSLKEISDGDVIISGNKNLCYANTINWKKLFGTSGQKTKIISNRGENSCKATGQVCHALCSPEGCWGPEPRDCVSCRNVSRGRECVDKCNLLEGEPREFVENSECIQCHPECLPQAMNITCTGRGPDNCIQCAHYIDGPHCVKTCPAGVMGENNTLVWKYADAGHVCHLCHPNCTYGCTGPGLEGCPTNGPKIPSIATGMVGALLLLLVVALGIGLFMRRRHIVRKRTLRRLLQERELVEP

SEQ ID NO: 665 - protein, 333 aa, Artificial Sequence
  Synthetic Polypeptide
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMTDPTRRF

SEQ ID NO: 666 - protein, 105 aa, Artificial Sequence
  Synthetic Polypeptide
MALPVTALLLPLALLLHAARPFEMLQMAGQCSQNEYFDSLLHACIPCQLRCSSNTPPLTCQRYCNASVTNSVKGTNAILWTCLGLSLIISLAVFVLMFLLRKINS

SEQ ID NO: 667 - protein, 188 aa, Artificial Sequence
  Synthetic Polypeptide
MATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 668 - protein, 241 aa, Artificial Sequence
  Synthetic Polypeptide
MSDSKEVPSLPFLRHLLEELDSHEDSLLLFLCHDAAPGCTTVTQALCSLSQQRKLTLAALVEMLYVLQRMDLLKSRFGLSKEGAEQLLGTSFLTRYRKLMVCVGEELDSSELRALRLFACNLNPSLSTALSESSRFVELVLALENVGLVSPSSVSVLADMLRTLRRLDLCQQLVEYEQQEQARYRYCYAASPSLPVRTLRRGHGASEHEQLCMPVQESSDSPELLRTPVQESSSDSPEQTT

SEQ ID NO: 669 - protein, 188 aa, Artificial Sequence; identical to SEQ ID NO: 667
  Synthetic Polypeptide

SEQ ID NO: 670 - protein, 400 aa, Artificial Sequence
  Synthetic Polypeptide
MLEGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLESGGGSGVDGFGDVGALESLRGNADLAYILSMEPCGHCLIINNVNFCRESGLRTRTGSNIDCEKLRRRFSSLHFMVEVKGDLTAKKMVLALLELAQQDHGALDCCVVVILSHGCQASHLQFPGAVYGTDGCPVSVEKIVNIFNGTSCPSLGGKPKLFFIQACGGEQKDHGFEVASTSPEDESPGSNPEPDATPFQEGLRTFDQLDAISSLPTPSDIFVSYSTFPGFVSWRDPKSGSWYVETLDDIFEQWAHSEDLQSLLLRVANAVSVKGIYKQMPGCFNFLRKKLFFKTS

SEQ ID NO: 671 - protein, 270 aa, Artificial Sequence
  Synthetic Polypeptide
MDWIWRILFLVGAATGAHSEVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 672 - protein, 246 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTIEDFAVYYCQQSTFGQGTKVEIKGGGGSGGGGSGGGGSQVYLVESGGGVVQPGRSLRLSCAASGFTFSNYGMHWVRQAPGKGLEWVALIWYDGSNKYYADSVKGRFTISRDNSKNTLYLQMTSLRVEDTAVYYCASNVDHWGQGTLVTVSS

SEQ ID NO: 673 - protein, 253 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSGGGGSGGGGSQVQLVESGGGWQPGRSLRLDCKASGITFSNSGMHWVRQAPGKGLEWVAVIYDGSKRYYADSVKGRFISRDNSKNTLFLQMNSLRAEDTAVYYCATNDDYWGQGTLVTVSS

SEQ ID NO: 674 - protein, 263 aa, Artificial Sequence
  Synthetic Polypeptide
MALPVTALLLPLALLLHAARPEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRGGGGSGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 675 - protein, 376 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTIEDFAVYYCQQSTFGQGTKVEIKGGGGSGGGGSGGGGSQVYLVESGGGVVQPGRSLRLSCAASGFTFSNYGMHWVRQAPGKGLEWVALIWYDGSNKYYADSVKGRFTISRDNSKNTLYLQMTSLRVEDTAVYYCASNVDHWGQGTLVTVSSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 676 - protein, 383 aa, Artificial Sequence
  Synthetic Polypeptide
MALPVTALLLPLALLLHAARPEIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKGGGGSGGGGSGGGGSQVQLVESGGGWQPGRSLRLDCKASGITFSNSGMHWVRQAPGKGLEWVAVIYDGSKRYYADSVKGRFISRDNSKNTLFLQMNSLRAEDTAVYYCATNDDYWGQGTLVTVSSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 677 - protein, 393 aa, Artificial Sequence
  Synthetic Polypeptide
MALPVTALLLPLALLLHAARPEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRGGGGSGGGGSGGGGSQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSGGGGSGGGGSGGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 678 - protein, 259 aa, Artificial Sequence
  Synthetic Polypeptide
MDWIWRILFLVGAATGAHSEIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIKGGGGSGGGGSGGGGSEVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSS

SEQ ID NO: 679 - protein, 47 aa, Artificial Sequence
  Synthetic Polypeptide
MDWIWRILFLVGAATGAHSGHRPLDKKREEAPSLRPAPPPISGGGYR

SEQ ID NO: 680 - protein, 301 aa, Artificial Sequence
  Synthetic Polypeptide
MTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 681 - protein, 408 aa, Artificial Sequence
  Synthetic Polypeptide
MGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLGTRGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLEGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 682 - protein, 75 aa, Artificial Sequence
  Synthetic Polypeptide
MQIFVKTLTGKTITLEVEPSDTIENVKAKIQDKEGIPPDQQRLIFAGKQLEDGRTLSDYNIQKESTLHLVLRLRG

SEQ ID NO: 683 - protein, 113 aa, Artificial Sequence
  Synthetic Polypeptide
DIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIK

SEQ ID NO: 684 - protein, 108 aa, Artificial Sequence
  Synthetic Polypeptide
DIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIK

SEQ ID NO: 685 - protein, 113 aa, Artificial Sequence
  Synthetic Polypeptide
DIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIK

SEQ ID NO: 686 - protein, 5 aa, Artificial Sequence
  Synthetic Polypeptide
GGGGG

SEQ ID NO: 687 - protein, 117 aa, Artificial Sequence
  Synthetic Polypeptide
QMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTV

SEQ ID NO: 688 - protein, 115 aa, Artificial Sequence
  Synthetic Polypeptide
EVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSS

SEQ ID NO: 689 - protein, 126 aa, Artificial Sequence
  Synthetic Polypeptide
QVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSS

SEQ ID NO: 690 - protein, 5 aa, Artificial Sequence
  Synthetic Polypeptide
GGGGG

SEQ ID NO: 691 - protein, 245 aa, Artificial Sequence
  Synthetic Polypeptide
DIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTV

SEQ ID NO: 692 - protein, 238 aa, Artificial Sequence
  Synthetic Polypeptide
DIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSS

SEQ ID NO: 693 - protein, 254 aa, Artificial Sequence
  Synthetic Polypeptide
DIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSS

SEQ ID NO: 694 - protein, 611 aa, Artificial Sequence
  Synthetic Polypeptide
DIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 695 - protein, 162 aa, Artificial Sequence
  Synthetic Polypeptide
MYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIW

SEQ ID NO: 696 - protein, 239 aa, Artificial Sequence
  Synthetic Polypeptide
MQIFVKTLTGKTITLEVEPSDTIENVKAKIQDKEGIPPDQQRLIFAGKQLEDGRTLSDYNIQKESTLHLVLRLRGASMYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIW

SEQ ID NO: 697 - protein, 235 aa, Artificial Sequence
  Synthetic Polypeptide
MYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIW

SEQ ID NO: 698 - protein, 310 aa, Artificial Sequence
  Synthetic Polypeptide
MQIFVKTLTGKTITLEVEPSDTIENVKAKIQDKEGIPPDQQRLIFAGKQLEDGRTLSDYNIQKESTLHLVLRLRGMYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIW

SEQ ID NO: 699 - protein, 332 aa, Artificial Sequence
  Synthetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSLE

SEQ ID NO: 700 - protein, 223 aa, Artificial Sequence
  Synthetic Polypeptide
RVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNF

SEQ ID NO: 701 - protein, 1273 aa, Artificial Sequence
  Synthetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 702 - protein, 419 aa, Artificial Sequence
  Synthetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 703 - protein, 222 aa, Artificial Sequence
  Synthetic Polypeptide
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQ

SEQ ID NO: 704 - protein, 275 aa, Artificial Sequence
  Synthetic Polypeptide
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPL

SEQ ID NO: 705 - protein, 805 aa, Artificial Sequence [sequence omitted]

SEQ ID NO: 706 - protein, 492 aa, Artificial Sequence
  Synthetic Polypeptide
MALNSGSPPAIGPYYENHGYQPENPYPAQPTVVPTVYEVHPAQYYPSPVPQYAPRVLTQASNPVVCTQPKSPSGTVCTSKTKKALCITLTLGTFLVGAALAAGLLWKFMGSKCSNSGIECDSSGTCINPSNWCDGVSHCPGGEDENRCVRLYGPNFILQVYSSQRKSWHPVCQDDWNENYGRAACRDMGYKNNFYSSQGIVDDSGSTSFMKLNTSAGNVDIYKKLYHSDACSSKAVVSLRCIACGVNLNSSRQSRIVGGESALPGAWPWQVSLHVQNVHVCGGSIITPEWIVTAAHCVEKPLNNPWHWTAFAGILRQSFMFYGAGYQVEKVISHPNYDSKTKNNDIALMKLQKPLTFNDLVKPVCLPNPGMMLQPEQLCWISGWGATEEKGKTSEVLNAAKVLLIETQRCNSRYVYDNLITPAMICAGFLQGNVDSCQGDSGGPLVTSKNNIWWLIGDTSWGSGCAKAYRPGVYGNVMVFTDWIYRQMRADG

SEQ ID NO: 707 - protein, 318 aa, Artificial Sequence
  Synthetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNF

SEQ ID NO: 708 - protein, 732 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 709 - protein, 733 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 710 - protein, 742 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 711 - protein, 726 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 712 - protein, 354 aa, Artificial Sequence
  Synthetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWN

SEQ ID NO: 713 - protein, 765 aa, Artificial Sequence
  Synthetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 714 - protein, 719 aa, Artificial Sequence
  Synthetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 715 - protein, 544 aa, Artificial Sequence
  Synthetic Polypeptide
MALPVTALLLPLALLLHAARPFEMLQMAGQCSQNEYFDSLLHACIPCQLRCSSNTPPLTCQRYCNASVTNSVKGTNATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 716 - protein, 724 aa, Artificial Sequence
  Synthetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 717 - protein, 716 aa, Artificial Sequence
  Synthetic Polypeptide
MALPVTALLLPLALLLHAARPGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 718 - protein, 934 aa, Artificial Sequence
  Synthetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHH

SEQ ID NO: 719 - protein, 886 aa, Artificial Sequence
  Synthetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQATRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 720 - protein, 519 aa, Artificial Sequence
  Synthetic Polypeptide
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPLTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHH

SEQ ID NO: 721 - protein, 984 aa, Artificial Sequence
  Synthetic Polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHH

SEQ ID NO: 722 - protein, 5 aa, Artificial Sequence
  Synthetic Polypeptide
GGGGG

SEQ ID NO: 723 - protein, 726 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 724 - protein, 720 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 725 - protein, 497 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 726 - protein, 503 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 727 - protein, 503 aa, Artificial Sequence
  Synthetic Polypeptide
MALPVTALLLPLALLLHAARPQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGGSGGGGSGGGGSDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 728 - protein, 916 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 729 - protein, 856 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 730 - protein, 855 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 731 - protein, 622 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 732 - protein, 847 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 733 - protein, 626 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 734 - protein, 848 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 735 - protein, 900 aa, Artificial Sequence
  Synthetic Polypeptide
MALPVTALLLPLALLLHAARPLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 736 - protein, 901 aa, Artificial Sequence
  Synthetic Polypeptide
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 737 - protein, 855 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 738 - protein, 937 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 739 - protein, 955 aa, Artificial Sequence
  Synthetic Polypeptide
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 740 - protein, 892 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 741 - protein, 630 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLESQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 742 - protein, 907 aa, Artificial Sequence
  Synthetic Polypeptide
MALPVTALLLPLALLLHAARPLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 743 - protein, 1032 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 744 - protein, 818 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 745 - protein, 818 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 746 - protein, 889 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 747 - protein, 930 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 748 - protein, 891 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 749 - protein, 933 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 750 - protein, 823 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 751 - protein, 648 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 752 - protein, 626 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 753 - protein, 626 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 754 - protein, 452 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 755 - protein, 417 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 756 - protein, 427 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 757 - protein, 410 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 758 - protein, 452 aa, Artificial Sequence
  Synthetic Polypeptide
MALPVTALLLPLALLLHAARPQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGGSGGGGSGGGGSDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 759 - protein, 417 aa, Artificial Sequence
  Synthetic Polypeptide
MALPVTALLLPLALLLHAARPQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGGSGGGGSGGGGSDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 760 - protein, 427 aa, Artificial Sequence
  Synthetic Polypeptide
MALPVTALLLPLALLLHAARPQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGGSGGGGSGGGGSDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 761 - protein, 410 aa, Artificial Sequence
  Synthetic Polypeptide
MALPVTALLLPLALLLHAARPQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSGGGGSGGGGSGGGGSDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 762 - protein, 643 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 763 - protein, 675 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 764 - protein, 725 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 765 - protein, 539 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 766 - protein, 309 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 767 - protein, 450 aa, Artificial Sequence
  Synthetic Polypeptide
MDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 768 - protein, 284 aa, Artificial Sequence
  Synthetic Polypeptide
MDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 769 - protein, 557 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 770 - protein, 327 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 771 - protein, 462 aa, Artificial Sequence
  Synthetic Polypeptide
MDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 772 - protein, 296 aa, Artificial Sequence
  Synthetic Polypeptide
MDWIWRILFLVGAATGAHSFEQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 773 - protein, 643 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 774 - protein, 675 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSLEDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 775 - protein, 698 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGGGGSGGGGSGDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 776 - protein, 663 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGGGGSGGGGSGFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 777 - protein, 673 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGGGGSGGGGSGQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 778 - protein, 656 aa, Artificial Sequence
  Synthetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGSGGGGSGGGGSGQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 779 - protein, 494 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 780 - protein, 727 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 781 - protein, 721 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 782 - protein, 498 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 783 - protein, 504 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 784 - protein, 504 aa, Artificial Sequence
  Synthetic Polypeptide
MALPVTALLLPLALLLHAARPQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVGGGGSGGGGSGGGGSDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 785 - protein, 917 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 786 - protein, 857 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 787 - protein, 856 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 788 - protein, 623 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 789 - protein, 848 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 790 - protein, 627 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 791 - protein, 849 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 792 - protein, 901 aa, Artificial Sequence
  Synthetic Polypeptide
MALPVTALLLPLALLLHAARPLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 793 - protein, 902 aa, Artificial Sequence
  Synthetic Polypeptide
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 794 - protein, 856 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 795 - protein, 938 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 796 - protein, 956 aa, Artificial Sequence
  Synthetic Polypeptide
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 797 - protein, 893 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 798 - protein, 631 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLESQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 799 - protein, 908 aa, Artificial Sequence
  Synthetic Polypeptide
MALPVTALLLPLALLLHAARPLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 800 - protein, 1033 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 801 - protein, 819 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 802 - protein, 819 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 803 - protein, 890 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 804 - protein, 931 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 805 - protein, 892 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 806 - protein, 934 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 807 - protein, 824 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 808 - protein, 649 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 809 - protein, 627 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 810 - protein, 627 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 811 - protein, 453 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 812 - protein, 418 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 813 - protein, 428 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 814 - protein, 411 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 815 - protein, 453 aa, Artificial Sequence
  Synthetic Polypeptide
MALPVTALLLPLALLLHAARPQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVGGGGSGGGGSGGGGSDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 816 - protein, 418 aa, Artificial Sequence
  Synthetic Polypeptide
MALPVTALLLPLALLLHAARPQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVGGGGSGGGGSGGGGSDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 817 - protein, 428 aa, Artificial Sequence
  Synthetic Polypeptide
MALPVTALLLPLALLLHAARPQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVGGGGSGGGGSGGGGSDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 818 - protein, 411 aa, Artificial Sequence
  Synthetic Polypeptide
MALPVTALLLPLALLLHAARPQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVGGGGSGGGGSGGGGSDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 819 - protein, 644 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 820 - protein, 676 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 821 - protein, 726 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 822 - protein, 544 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 823 - protein, 314 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 824 - protein, 446 aa, Artificial Sequence
  Synthetic Polypeptide
MDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 825 - protein, 280 aa, Artificial Sequence
  Synthetic Polypeptide
MDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 826 - protein, 562 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 827 - protein, 332 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 828 - protein, 458 aa, Artificial Sequence
  Synthetic Polypeptide
MDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 829 - protein, 292 aa, Artificial Sequence
  Synthetic Polypeptide
MDWIWRILFLVGAATGAHSFEQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 830 - protein, 644 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 831 - protein, 676 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVLEDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 832 - protein, 699 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGGGGSGGGGSGDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 833 - protein, 664 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGGGGSGGGGSGFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 834 - protein, 674 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGGGGSGGGGSGQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 835 - protein, 657 aa, Artificial Sequence
  Synthetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGSGGGGSGGGGSGQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 836 - protein, 5 aa, Artificial Sequence
  Synthetic Polypeptide
GGGGG

SEQ ID NO: 837 - protein, 736 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 838 - protein, 730 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 839 - protein, 507 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 840 - protein, 513 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 841 - protein, 513 aa, Artificial Sequence
  Synthetic Polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSGGGGSGGGGSGGGGSDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 842 - protein, 926 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 843 - protein, 866 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 844 - protein, 865 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 845 - protein, 632 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 846 - protein, 857 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 847 - protein, 636 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 848 - protein, 858 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 849 - protein, 910 aa, Artificial Sequence
  Synthetic Polypeptide
MALPVTALLLPLALLLHAARPLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 850 - protein, 911 aa, Artificial Sequence
  Synthetic Polypeptide
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 851 - protein, 865 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 852 - protein, 947 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 853 - protein, 965 aa, Artificial Sequence
  Synthetic Polypeptide
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 854 - protein, 902 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 855 - protein, 640 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLESQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 856 - protein, 917 aa, Artificial Sequence
  Synthetic Polypeptide
MALPVTALLLPLALLLHAARPLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 857 - protein, 1042 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 858 - protein, 828 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 859 - protein, 828 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 860 - protein, 899 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 861 - protein, 940 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 862 - protein, 901 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 863 - protein, 943 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 864 - protein, 833 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 865 - protein, 658 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 866 - protein, 636 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 867 - protein, 636 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 868 - protein, 462 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 869 - protein, 427 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 870 - protein, 437 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 871 - protein, 420 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 872 - protein, 462 aa, Artificial Sequence
  Synthetic Polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSGGGGSGGGGSGGGGSDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 873 - protein, 427 aa, Artificial Sequence
  Synthetic Polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSGGGGSGGGGSGGGGSDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 874 - protein, 437 aa, Artificial Sequence
  Synthetic Polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSGGGGSGGGGSGGGGSDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 875 - protein, 420 aa, Artificial Sequence
  Synthetic Polypeptide
MALPVTALLLPLALLLHAARPQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSGGGGSGGGGSGGGGSDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 876 - protein, 653 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 877 - protein, 685 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 878 - protein, 735 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 879 - protein, 544 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 880 - protein, 314 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 881 - protein, 455 aa, Artificial Sequence
  Synthetic Polypeptide
MDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 882 - protein, 289 aa, Artificial Sequence
  Synthetic Polypeptide
MDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 883 - protein, 562 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 884 - protein, 332 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 885 - protein, 467 aa, Artificial Sequence
  Synthetic Polypeptide
MDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 886 - protein, 301 aa, Artificial Sequence
  Synthetic Polypeptide
MDWIWRILFLVGAATGAHSFEQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 887 - protein, 653 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 888 - protein, 685 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSLEDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 889 - protein, 708 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGGGGSGGGGSGDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 890 - protein, 673 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGGGGSGGGGSGFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 891 - protein, 683 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGGGGSGGGGSGQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 892 - protein, 666 aa, Artificial Sequence
  Synthetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGSGGGGSGGGGSGQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 893 - protein, 5 aa, Artificial Sequence
  Synthetic Polypeptide
GGGGG

SEQ ID NO: 894 - protein, 720 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 895 - protein, 714 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 896 - protein, 491 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 897 - protein, 497 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 898 - protein, 497 aa, Artificial Sequence
  Synthetic Polypeptide
MALPVTALLLPLALLLHAARPEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSGGGGSGGGGSGGGGSDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKTREQKLISEEDLAKPTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 899 - protein, 910 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLAKPTTTPAPRPPTPAPTIASQPLSLRPEACRPAAGGAVHTRGLDFACDIYIWAPLAGTCGVLLLSLVITLYCGRARVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRSRGSGATNFSLLKQAGDVEENPGPGIHMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTPLETDFYDYKDDDDKTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 900 - protein, 850 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 901 - protein, 849 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 902 - protein, 616 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 903 - protein, 841 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 904 - protein, 620 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 905 - protein, 842 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGGIHTMATYEVLCEVARKLGTDDREVVLFLLNVFIPQPTLAQLIGALRALKEEGRLTFPLLAECLFRAGRRDLLRDLLHLDPRFLERHLAGTMSYFSPYQLTVLHVDGELCARDIRSLIFLSKDTIGSRSTPQTFLHWVYCMENLDLLGPTDVDALMSMLRSLSRVDLQRQVQTLMGLHLSGPSHSQHYRHTP

SEQ ID NO: 906 - protein, 894 aa, Artificial Sequence
  Synthetic Polypeptide
MALPVTALLLPLALLLHAARPLEGKPIPNPLLGLDSTGSGEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTSMALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 907 - protein, 895 aa, Artificial Sequence
  Synthetic Polypeptide
MALPVTALLLPLALLLHAARPLEQKLISEEDLGSGDRPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSSSRAKRSGSGVKQTLNFDLLKLAGDVESNPGPTSMALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 908 - protein, 849 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 909 - protein, 931 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 910 - protein, 949 aa, Artificial Sequence
  Synthetic Polypeptide
MALPVTALLLPLALLLHAARPLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTSMALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 911 - protein, 886 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 912 - protein, 624 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLESQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 913 - protein, 901 aa, Artificial Sequence
  Synthetic Polypeptide
MALPVTALLLPLALLLHAARPLEGKPIPNPLLGLDSTGSGDKQLDADVSPKPTIFLPSIAETKLQKAGTYLCLLEKFFPDVIKIHWQEKKSNTILGSQEGNTMKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGSQPHTKPSVFVMKNGTNVACLVKEFYPKDIRINLVSSKKITEFDPAIVISPSGKYNAVKLGKYEDSNSVTCSVQHDNKTVHSTDFEVKTDSTDHVKPKETENTKQPSKSCHKPKAIVHTEKVNMMSLTVLGLRMLFAKTVAVNFLLTAKLFFLRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 914 - protein, 1026 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 915 - protein, 812 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 916 - protein, 812 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSKAEIAHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKCVLDMRSMDFKSNSAVAWSNKSDFACANAFNNSIIPEDTFFPSSDVPCGTQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 917 - protein, 883 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 918 - protein, 924 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 919 - protein, 885 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 920 - protein, 927 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGSQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCGTQSFGLLDPKLCYLLDGILFIYGVILTALFLKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 921 - protein, 817 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 922 - protein, 642 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSPIKTDVITMDPKDNCSKDANDTLLLQLTNTSAYYMYLLLLLKSVVYFAIITCCLLRRTAFCCNGEKSRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCEVKTDSTDHVKPKETENTKQPSKSCHKPKAIVHTEKVNMMSLTVLGLRMLFAKTVAVNFLLTAKLFFL

SEQ ID NO: 923 - protein, 620 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGITSASYHQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSSDVPCDVKLVEKSFETDTNLNFQNLSVIGFRILLLKVAGFNLLMTLRLWSS

SEQ ID NO: 924 - protein, 620 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECSGRADCGFTSESYQQGVLSATILYEILLGKATLYAVLVSALVLMAMVKRKDSRGRAKRSGSGATNFSLLKQAGDVEENPGPTSMDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCIPEDTFFPSPESSCDVKLVEKSFETDTNLNFQNLSVIGFRILLLKVAGFNLLMTLRLWSS

SEQ ID NO: 925 - protein, 446 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 926 - protein, 411 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 927 - protein, 421 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 928 - protein, 404 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 929 - protein, 446 aa, Artificial Sequence
  Synthetic Polypeptide
MALPVTALLLPLALLLHAARPEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSGGGGSGGGGSGGGGSDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKTRDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 930 - protein, 411 aa, Artificial Sequence
  Synthetic Polypeptide
MALPVTALLLPLALLLHAARPEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSGGGGSGGGGSGGGGSDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKTRFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 931 - protein, 421 aa, Artificial Sequence
  Synthetic Polypeptide
MALPVTALLLPLALLLHAARPEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSGGGGSGGGGSGGGGSDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKTRQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 932 - protein, 404 aa, Artificial Sequence
  Synthetic Polypeptide
MALPVTALLLPLALLLHAARPEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSGGGGSGGGGSGGGGSDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKTRQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 933 - protein, 637 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 934 - protein, 669 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 935 - protein, 719 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDLGSGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVRAKRSGSGVKQTLNFDLLKLAGDVESNPGPSRSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 936 - protein, 539 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 937 - protein, 309 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEDLKNVFPPEVAVFEPSEAEISHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 938 - protein, 444 aa, Artificial Sequence
  Synthetic Polypeptide
MDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 939 - protein, 278 aa, Artificial Sequence
  Synthetic Polypeptide
MDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRIQNPDPAVYQLRDSKSSDKSVCLFTDFDSQTNVSQSKDSDVYITDKTVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 940 - protein, 557 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 941 - protein, 327 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKLEGKPIPNPLLGLDSTGSGEDLKNVFPPEVAVFEPSEAEISHTQKATLVCLATGFYPDHVELSWWVNGKEVHSGVCTDPQPLKEQPALNDSRYCLSSRLRVSATFWQNPRNHFRCQVQFYGLSENDEWTQDRAKPVTQIVSAEAWGRADCGFTSESYQQGVLSATILYEILLGKATLYAVLVSALVLMAMVKRKDSRG

SEQ ID NO: 942 - protein, 456 aa, Artificial Sequence
  Synthetic Polypeptide
MDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSSRAKRSGSGVKQTLNFDLLKLAGDVESNPGPSRGHMAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 943 - protein, 290 aa, Artificial Sequence
  Synthetic Polypeptide
MDWIWRILFLVGAATGAHSFEEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTREQKLISEEDGSGIQNPDPAVYQLRDSKSSDKSVCLFTDFDSQTNVSQSKDSDVYITDKCVLDMRSMDFKSNSAVAWSNKSDFACANAFNNSIIPEDTFFPSPESSCDVKLVEKSFETDTNLNFQNLSVIGFRILLLKVAGFNLLMTLRLWSS

SEQ ID NO: 944 - protein, 637 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGIQNPDPAVYQLRDSKSSDKSVCLFTDFDSQTNVSQSKDSDVYITDKTVLDMRSMDFKSNSAVAWSNKSDFACANAFNNSIIPEDTFFPSSDVPCDVKLVEKSFETDTNLNFQNLSVIGFRILLLKVAGFNLLMTLRLWSSRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 945 - protein, 669 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSLEDLKNVFPPEVAVFEPSKAEIAHTQKATLVCLATGFYPDHVELSWWVNGKEVHSGVSTDPQPLKEQPALNDSRYCLSSRLRVSATFWQNPRNHFRCQVQFYGLSENDEWTQDRAKPVTQIVSAEAWGRADCGITSASYHQGVLSATILYEILLGKATLYAVLVSALVLMAMVKRKDSRGRAKRSGSGATNFSLLKQAGDVEENPGPTRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 946 - protein, 692 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGGGGSGGGGSGDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRIRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 947 - protein, 657 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGGGGSGGGGSGFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNKRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 948 - protein, 667 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGGGGSGGGGSGQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRNRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 949 - protein, 650 aa, Artificial Sequence
  Synthetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGSGGGGSGGGGSGQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRRAKRSGSGVKQTLNFDLLKLAGDVESNPGPSRGHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 950 - skipped

SEQ ID NO: 951 - protein, 22 aa, Artificial Sequence
  Synthetic Polypeptide
VKQTLNFDLLKLAGDVESNPGP

SEQ ID NO: 952 - protein, 18 aa, Artificial Sequence
  Synthetic Polypeptide
EGRGSLLTCGDVEENPGP

SEQ ID NO: 953 - protein, 19 aa, Artificial Sequence
  Synthetic Polypeptide
ATNFSLLKQAGDVEENPGP

SEQ ID NO: 954 - protein, 20 aa, Artificial Sequence
  Synthetic Polypeptide
QCTNYALLKLAGDVESNPGP

SEQ ID NO: 955 - protein, 4 aa, Artificial Sequence
  Synthetic Polypeptide
SGSG

SEQ ID NO: 956 - protein, 4 aa, Artificial Sequence
  Synthetic Polypeptide
RAKR

SEQ ID NO: 957 - protein, 4 aa, Artificial Sequence
  Synthetic Polypeptide
RAKR

SEQ ID NO: 958 - protein, 4 aa, Artificial Sequence
  Synthetic Polypeptide
RAKR

SEQ ID NO: 959 - skipped

SEQ ID NO: 960 - protein, 12 aa, Artificial Sequence
  Synthetic Polypeptide
QSVLYSSINKNY

SEQ ID NO: 961 - protein, 4 aa, Artificial Sequence
  Synthetic Polypeptide
WAST

SEQ ID NO: 962 - protein, 9 aa, Artificial Sequence
  Synthetic Polypeptide
QQYYSTPYT

SEQ ID NO: 963 - protein, 11 aa, Artificial Sequence
  Synthetic Polypeptide
RASQGISSYLA

SEQ ID NO: 964 - protein, 4 aa, Artificial Sequence
  Synthetic Polypeptide
AAST

SEQ ID NO: 965 - protein, 10 aa, Artificial Sequence
  Synthetic Polypeptide
QQLNSYPPYT

SEQ ID NO: 966 - protein, 12 aa, Artificial Sequence
  Synthetic Polypeptide
QSLLDSDDGNTY

SEQ ID NO: 967 - protein, 4 aa, Artificial Sequence
  Synthetic Polypeptide
TLSY

SEQ ID NO: 968 - protein, 9 aa, Artificial Sequence
  Synthetic Polypeptide
MQRIEFPLT

SEQ ID NO: 969 - skipped

SEQ ID NO: 970 - protein, 5 aa, Artificial Sequence
  Synthetic Polypeptide
TYWIG

SEQ ID NO: 971 - protein, 8 aa, Artificial Sequence
  Synthetic Polypeptide
IYPGDSET

SEQ ID NO: 972 - protein, 10 aa, Artificial Sequence
  Synthetic Polypeptide
GSGISTPMDV

SEQ ID NO: 973 - protein, 5 aa, Artificial Sequence
  Synthetic Polypeptide
SNYMS

SEQ ID NO: 974 - protein, 7 aa, Artificial Sequence
  Synthetic Polypeptide
IYSGGST

SEQ ID NO: 975 - protein, 7 aa, Artificial Sequence
  Synthetic Polypeptide
EAYGMDV

SEQ ID NO: 976 - protein, 5 aa, Artificial Sequence
  Synthetic Polypeptide
GYYMH

SEQ ID NO: 977 - protein, 8 aa, Artificial Sequence
  Synthetic Polypeptide
INPNSGGT

SEQ ID NO: 978 - protein, 17 aa, Artificial Sequence
  Synthetic Polypeptide
VPYCSSTSCHRDWYFDL

SEQ ID NO: 979 - skipped

SEQ ID NO: 980 - protein, 10 aa, Artificial Sequence
  Synthetic Polypeptide
KLPDDFTGCV

SEQ ID NO: 981 - protein, 9 aa, Artificial Sequence
  Synthetic Polypeptide
ILPDPSKPS

SEQ ID NO: 982 - protein, 9 aa, Artificial Sequence
  Synthetic Polypeptide
VLNDILSRL

SEQ ID NO: 983 - protein, 9 aa, Artificial Sequence
  Synthetic Polypeptide
VVFLHVTYV

SEQ ID NO: 984 - protein, 9 aa, Artificial Sequence
  Synthetic Polypeptide
LITGRLQSL

SEQ ID NO: 985 - protein, 9 aa, Artificial Sequence
  Synthetic Polypeptide
FIAGLIAIV

SEQ ID NO: 986 - protein, 9 aa, Artificial Sequence
  Synthetic Polypeptide
RLNEVAKNL

SEQ ID NO: 987 - protein, 9 aa, Artificial Sequence
  Synthetic Polypeptide
NLNESLIDL

SEQ ID NO: 988 - protein, 9 aa, Artificial Sequence
  Synthetic Polypeptide
ALNTLVKQL

SEQ ID NO: 989 - protein, 9 aa, Artificial Sequence
  Synthetic Polypeptide
SIIAYTMSL

SEQ ID NO: 990 - protein, 18 aa, Artificial Sequence
  Synthetic Polypeptide
IRGWIFGTTLDSKTQSLL

SEQ ID NO: 991 - protein, 13 aa, Artificial Sequence
  Synthetic Polypeptide
CTFEYVSQPFLMD

SEQ ID NO: 992 - protein, 13 aa, Artificial Sequence
  Synthetic Polypeptide
QPFLMDLEGKQGN

SEQ ID NO: 993 - protein, 23 aa, Artificial Sequence
  Synthetic Polypeptide
TRFQTLLALHRSYLTPGDSSSGW

SEQ ID NO: 994 - protein, 18 aa, Artificial Sequence
  Synthetic Polypeptide
KSFTVEKGIYQTSNFRVQ

SEQ ID NO: 995 - protein, 18 aa, Artificial Sequence
  Synthetic Polypeptide
KSFTVEKGIYQTSNFRVQ

SEQ ID NO: 996 - protein, 17 aa, Artificial Sequence
  Synthetic Polypeptide
SASFSTFKCYGVSPTKL

SEQ ID NO: 997 - protein, 17 aa, Artificial Sequence
  Synthetic Polypeptide
SASFSTFKCYGVSPTKL

SEQ ID NO: 998 - protein, 18 aa, Artificial Sequence
  Synthetic Polypeptide
QLIRAAEIRASANLAATK

SEQ ID NO: 999 - protein, 15 aa, Artificial Sequence
  Synthetic Polypeptide
HWFVTQRNFYEPQII

SEQ ID NO: 1000 - protein, 18 aa, Artificial Sequence
  Synthetic Polypeptide
NLDSKVGGNYNYLYRLFR

SEQ ID NO: 1001 - protein, 13 aa, Artificial Sequence
  Synthetic Polypeptide
LLNKHIDAYKTFP

SEQ ID NO: 1002 - protein, 9 aa, Artificial Sequence
  Synthetic Polypeptide
LQLPQGTTL

SEQ ID NO: 1003 - protein, 9 aa, Artificial Sequence
  Synthetic Polypeptide
ALNTPKDHI

SEQ ID NO: 1004 - protein, 9 aa, Artificial Sequence
  Synthetic Polypeptide
GDAALALLL

SEQ ID NO: 1005 - protein, 9 aa, Artificial Sequence
  Synthetic Polypeptide
LLLDRLNQL

SEQ ID NO: 1006 - protein, 9 aa, Artificial Sequence
  Synthetic Polypeptide
RLNQLESKM

SEQ ID NO: 1007 - protein, 9 aa, Artificial Sequence
  Synthetic Polypeptide
GMSRIGMEV

SEQ ID NO: 1008 - protein, 9 aa, Artificial Sequence
  Synthetic Polypeptide
LALLLLDRL

SEQ ID NO: 1009 - protein, 10 aa, Artificial Sequence
  Synthetic Polypeptide
GDAALALLLL

SEQ ID NO: 1010 - protein, 10 aa, Artificial Sequence
  Synthetic Polypeptide
LLLLDRLNQL

SEQ ID NO: 1011 - protein, 10 aa, Artificial Sequence
  Synthetic Polypeptide
TKAYNVTQAF

SEQ ID NO: 1012 - protein, 9 aa, Artificial Sequence
  Synthetic Polypeptide
NFKDQVILL

SEQ ID NO: 1013 - protein, 9 aa, Artificial Sequence
  Synthetic Polypeptide
KTFPPTEPK

SEQ ID NO: 1014 - protein, 10 aa, Artificial Sequence
  Synthetic Polypeptide
MEVTPSGTWL

SEQ ID NO: 1015 - protein, 10 aa, Artificial Sequence
  Synthetic Polypeptide
TKAYNVTQAF

SEQ ID NO: 1016 - protein, 9 aa, Artificial Sequence
  Synthetic Polypeptide
NFKDQVILL

SEQ ID NO: 1017 - protein, 10 aa, Artificial Sequence
  Synthetic Polypeptide
TLACFVLAAV

SEQ ID NO: 1018 - protein, 9 aa, Artificial Sequence
  Synthetic Polypeptide
GLMWLSYFI

SEQ ID NO: 1019 - protein, 9 aa, Artificial Sequence
  Synthetic Polypeptide
HLRIAGHHL

SEQ ID NO: 1020 - protein, 9 aa, Artificial Sequence
  Synthetic Polypeptide
CLEASFNYL

SEQ ID NO: 1021 - protein, 9 aa, Artificial Sequence
  Synthetic Polypeptide
WLMWLIINL

SEQ ID NO: 1022 - protein, 9 aa, Artificial Sequence
  Synthetic Polypeptide
ILLLDQALV

SEQ ID NO: 1023 - protein, 9 aa, Artificial Sequence
  Synthetic Polypeptide
SACVLAAEC

SEQ ID NO: 1024 - protein, 9 aa, Artificial Sequence
  Synthetic Polypeptide
SLPGVFCGV

SEQ ID NO: 1025 - protein, 9 aa, Artificial Sequence
  Synthetic Polypeptide
TLMNVLTLV

SEQ ID NO: 1026 - protein, 9 aa, Artificial Sequence
  Synthetic Polypeptide
SMWALIISV

SEQ ID NO: 1027 - protein, 15 aa, Artificial Sequence
  Synthetic Polypeptide
RIFTIGTVTLKQGEI

SEQ ID NO: 1028 - protein, 9 aa, Artificial Sequence
  Synthetic Polypeptide
TVTLKQGEI

SEQ ID NO: 1029-1040 - skipped (12 entries)

SEQ ID NO: 1041 - DNA, 321 bp, Artificial Sequence
  Synthetic Polynucleotide
ggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1042 - DNA, 69 bp, Artificial Sequence
  Synthetic Polynucleotide
ttccagtgcaatcagtgcggggcctcattcacccagaagggcaacctgctccggcacatcaagctgcat

SEQ ID NO: 1043 - DNA, 159 bp, Artificial Sequence
  Synthetic Polynucleotide
ttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtt

SEQ ID NO: 1044 - DNA, 297 bp, Artificial Sequence
  Synthetic Polynucleotide
ttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1045 - DNA, 504 bp, Artificial Sequence
  Synthetic Polynucleotide
ggcaagttccagtgcaatcagtgcggagccagcttcacccagaacgtgctgatggtgcacaagagaagccacaccggcgagaggcccttccagtgtaaccagtgtggcgcttccttcacacagaagggcaacctgctgcggcacatcaagctgcactctggcgagaagccttttcaatgcaatcaatgtggggcctctttcacccagcggagagatgccctgacaggccacctgagaacacacagcgtcagaccctttcagtgtaatcaatgcggcgcatcttttacgcagaagggaaatctgctccgccatattaagctgcacagcggggagaaaccatttcagtgcaaccagtgcggggcctcctttactcagaaaggcaatctcctgagacacatcaaactccacagcggcgaaaagccgttccaatgtaatcagtgcggtgcatcattcacccaaaaaggcaacttgctcagacacattaagctccattccggggagaag

SEQ ID NO: 1046 - skipped

SEQ ID NO: 1047 - DNA, 6828 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcccgcgccaagagaagcggatctggccaatgcactaattacgcattgctcaagctggccggtgacgttgagagtaatcctggccccatggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttg

SEQ ID NO: 1048 - DNA, 3090 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagcagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcc

SEQ ID NO: 1049 - DNA, 5919 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcc

SEQ ID NO: 1050 - DNA, 2589 bp, Artificial Sequence
  Synthetic Polynucleotide
atgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 1051 - DNA, 2820 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtgctagcatgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 1052 - DNA, 2808 bp, Artificial Sequence
  Synthetic Polynucleotide
atgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 1053 - DNA, 3033 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtatgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggcctaa

SEQ ID NO: 1054 - DNA, 993 bp, Artificial Sequence
  Synthetic Polynucleotide
atgagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1055 - DNA, 975 bp, Artificial Sequence
  Synthetic Polynucleotide
atgagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1056 - DNA, 4140 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1057 - DNA, 4122 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1058 - DNA, 1584 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1059 - DNA, 1560 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1060 - DNA, 993 bp, Artificial Sequence
  Synthetic Polynucleotide
atggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagggatccggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1061 - DNA, 969 bp, Artificial Sequence
  Synthetic Polynucleotide
atggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1062 - DNA, 3417 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagcagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1063 - DNA, 3165 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagcagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcat

SEQ ID NO: 1064 - DNA, 3255 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagcagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgtt

SEQ ID NO: 1065 - DNA, 3393 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagcagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1066 - DNA, 6246 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaa

SEQ ID NO: 1067 - DNA, 2916 bp, Artificial Sequence
  Synthetic Polynucleotide
atgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaataa

SEQ ID NO: 1068 - DNA, 3147 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtgctagcatgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaataa

SEQ ID NO: 1069 - DNA, 3135 bp, Artificial Sequence
  Synthetic Polynucleotide
atgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaataa

SEQ ID NO: 1070 - DNA, 3360 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtatgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggcgtccaagtcgaaaccattagtcccggcgatggcagaacatttcctaaaaggggacaaacatgtgtcgtccattatacaggcatgttggaggacggcaaaaaggggatcctggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgaataa

SEQ ID NO: 1071 - DNA, 6222 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaa

SEQ ID NO: 1072 - DNA, 2892 bp, Artificial Sequence
  Synthetic Polynucleotide
atgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaataa

SEQ ID NO: 1073 - DNA, 3123 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtgctagcatgtacccctacgacgtgccagactacgcctggtatctgaagttcctgcggcagtatttcattgccggcctgatcgccatcgtggccgacaacatttggcggctgaacgaggtggcaaagaacctggccgataacatctggaacctgaacgagagcctgatcgacctggctgacaagcagtggcggctcaatcagctggaaagcaagatggcagacaacatctggggcatgagccggatcggaatggaagtggccgataggatttggctggccctgctgctgcttgatcggctcgccgacaaacagtatggcgacgctgctctggctctgctcctgctggctgataagagatggctgcttctgctggaccggctgaatcaactcgctgacaatatctggaccctggcctgctttgtgctggccgctgtcgccgataatatctacggcctgatgtggctgagctactttatcgccgaccggatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaataa

SEQ ID NO: 1074 - DNA, 3111 bp, Artificial Sequence
  Synthetic Polynucleotide
atgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaataa

SEQ ID NO: 1075 - DNA, 3336 bp, Artificial Sequence
  Synthetic Polynucleotide
atgcagattttcgtcaagaccctgaccggcaagaccatcacactggaagtggaacccagcgacaccatcgagaacgtgaaggccaagatccaggacaaagagggcatccctcctgaccagcagagactgatcttcgccggcaagcagctggaagatggcagaaccctgagcgactacaacatccagaaagagtctaccctgcacctggtgctgagactgagaggtatgtacccctacgacgtgccagactacgcctggtatctgaagttcctgcggcagtacatcagaggctggatcttcggcaccacactggacagcaagacccagtctctgctggccgacaacatctggtgcaccttcgagtacgtgtcccagcctttcctgatggacgccgataatatctggcagccattcctcatggatctggaaggcaagcagggcaacgccgacaagcagtggaccagatttcagaccctgctggccctgcacagaagctaccttacacctggcgatagcagcagcggctgggccgacaatatttggaagtccttcaccgtggaaaagggcatctaccagaccagcaacttcagagtgcaggccgacaggatttggagcgccagcttcagcaccttcaagtgctatggcgtgtcccctaccaagctggccgataagagatggcagctgattagagccgccgagatcagagcctctgccaatctggccgccaccaaggccgataacatttggcattggttcgtgacccagcggaacttctacgagccccagatcattgctgacaatatctacaacctggactccaaagtcggcggcaactacaactacctgtaccggctgttccgggccgacagaatctggctgctgaacaagcacatcgacgcctacaagacattccccgctgataacatctggagggccaagcgatctggatctggagcaacaaacttctcactactcaaacaagcaggtgacgtggaggagaatcccgggcctactagtatggcagattccaacggtactattaccgttgaagagcttaaaaagctccttgaacaatggaacctagtaataggtttcctattccttacatggatttgtcttctacaatttgcctatgccaacaggaataggtttttgtatataattaagttaattttcctctggctgttatggccagtaactttagcttgttttgtgcttgctgctgtttacagaataaattggatcaccggtggaattgctatcgcaatggcttgtcttgtaggcttgatgtggctcagctacttcattgcttctttcagactgtttgcgcgtacgcgttccatgtggtcattcaatccagaaactaacattcttctcaacgtgccactccatggcactattctgaccagaccgcttctagaaagtgaactcgtaatcggagctgtgatccttcgtggacatcttcgtattgctggacaccatctaggacgctgtgacatcaaggacctgcctaaagaaatcactgttgctacatcacgaacgctttcttattacaaattgggagcttcgcagcgtgtagcaggtgactcaggttttgctgcatacagtcgctacaggattggcaactataaattaaacacagaccattccagtagcagtgacaatattgctttgcttgtacagcgcgccaagagaagcggatctggcgtgaagcagaccctgaatttcgacctgctgaagctggctggcgacgtggaatccaacccaggccctatgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccggatccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaataa

SEQ ID NO: 1076 - skipped

SEQ ID NO: 1077 - DNA, 3237 bp, Artificial Sequence
  Synthetic Polynucleotide
atggacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1078 - DNA, 2355 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1079 - DNA, 2466 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacacgcgtggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1080 - DNA, 990 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtaccaccaccaagcctgtgctgcggaccccttctcctgtgcatccaacaggcacaagccagcctcagaggcccgaagattgcagacctagaggcagcgtgaaaggcaccggcctggatttcgcctgcgacatctatatctgggctcctctggccggcatctgtgtggctccactgctgagcctgatcatcaccctgatctgctaccacagaagc

SEQ ID NO: 1081 - DNA, 2199 bp, Artificial Sequence; identical to SEQ ID NO: 238
  Synthetic Polynucleotide

SEQ ID NO: 1082 - DNA, 2202 bp, Artificial Sequence; identical to SEQ ID NO: 239
  Synthetic Polynucleotide

SEQ ID NO: 1083 - DNA, 2229 bp, Artificial Sequence; identical to SEQ ID NO: 240
  Synthetic Polynucleotide

SEQ ID NO: 1084 - DNA, 2181 bp, Artificial Sequence; identical to SEQ ID NO: 241
  Synthetic Polynucleotide

SEQ ID NO: 1085 - DNA, 2298 bp, Artificial Sequence; identical to SEQ ID NO: 243
  Synthetic Polynucleotide

SEQ ID NO: 1086 - DNA, 2160 bp, Artificial Sequence; identical to SEQ ID NO: 244
  Synthetic Polynucleotide

SEQ ID NO: 1087 - DNA, 1635 bp, Artificial Sequence; identical to SEQ ID NO: 245
  Synthetic Polynucleotide

SEQ ID NO: 1088 - DNA, 2175 bp, Artificial Sequence; identical to SEQ ID NO: 246
  Synthetic Polynucleotide

SEQ ID NO: 1089 - DNA, 2151 bp, Artificial Sequence; identical to SEQ ID NO: 247
  Synthetic Polynucleotide

SEQ ID NO: 1090 - DNA, 2802 bp, Artificial Sequence; identical to SEQ ID NO: 248
  Synthetic Polynucleotide

SEQ ID NO: 1091 - DNA, 2661 bp, Artificial Sequence; identical to SEQ ID NO: 249
  Synthetic Polynucleotide

SEQ ID NO: 1092 - DNA, 1557 bp, Artificial Sequence; identical to SEQ ID NO: 250
  Synthetic Polynucleotide

SEQ ID NO: 1093 - DNA, 2952 bp, Artificial Sequence; identical to SEQ ID NO: 251
  Synthetic Polynucleotide

SEQ ID NO: 1094 - skipped

SEQ ID NO: 1095 - DNA, 3231 bp, Artificial Sequence
  Synthetic Polynucleotide
atggacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1096 - DNA, 2349 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1097 - DNA, 2460 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1098 - DNA, 2193 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1099 - DNA, 2196 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1100 - DNA, 2223 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1101 - DNA, 2175 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1102 - DNA, 2292 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1103 - DNA, 2154 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1104 - DNA, 1629 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1105 - DNA, 2169 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1106 - DNA, 2145 bp, Artificial Sequence
  Synthetic Polynucleotide
atggccttaccagtgaccgccttgctcctgccgctggccttgctgctccacgccgccaggccgggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1107 - DNA, 2796 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaaacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1108 - DNA, 2655 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1109 - DNA, 1551 bp, Artificial Sequence
  Synthetic Polynucleotide
atggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1110 - DNA, 2946 bp, Artificial Sequence
  Synthetic Polynucleotide
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccacgcgtggaggcagtggtaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1111 - skipped

SEQ ID NO: 1112 - DNA, 3168 bp, Artificial Sequence
  Synthetic Polynucleotide
atggacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1113 - DNA, 2286 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1114 - DNA, 2397 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1115 - DNA, 2130 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1116 - DNA, 2133 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1117 - DNA, 2160 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1118 - DNA, 2112 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1119 - DNA, 2229 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1120 - DNA, 2091 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1121 - DNA, 1566 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1122 - DNA, 2106 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1123 - DNA, 2082 bp, Artificial Sequence
  Synthetic Polynucleotide
atggccttaccagtgaccgccttgctcctgccgctggccttgctgctccacgccgccaggccgggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1124 - DNA, 2733 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaaacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1125 - DNA, 2592 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1126 - DNA, 1488 bp, Artificial Sequence
  Synthetic Polynucleotide
atggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1127 - DNA, 2883 bp, Artificial Sequence
  Synthetic Polynucleotide
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccacgcgtggaggcagtggtgaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1128 - skipped

SEQ ID NO: 1129 - DNA, 3183 bp, Artificial Sequence
  Synthetic Polynucleotide
atggacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacaacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1130 - DNA, 2301 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 1131 - DNA, 2412 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1132 - DNA, 2145 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggacaggcccctaagctgctgatctacggcgctaccacactggaaacaggcgtgcccagcagattttctggcagcggctctggcaccgactacaccctgacaatatccagcctccagcctgaggacttcgccacctactactgtcagcagagctggaacaccccttggacattcggccagggcaccaagctggaaatcaagagaggcggaggcggaagtggaggcggaggatctggcggcggaggctctcaagttcagcttcaacagcctggcgctgagctggtcaaacctggcgcttctgtgaagatgagctgcaaagccagcggctacgccttcagcagctactggatcaactggatgaagcagaaacccggccagggactcgaatggatcggccaaatctatcccggcgacggcgacaccaactacaacggcaagttcaagggcagagccacactgaccgccgatacctctagcagcacagcctacatgcagctgagcagcctgaccagcgaagatagcgccgtgtacttctgtgcccggtccatcacaacagtcgtgggctgcgctatggactattggggccagggaacaagcgtgaccgtgtctagtacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1133 - DNA, 2148 bp, Artificial Sequence
  Synthetic Polynucleotide
atggccttaccagtgaccgccttgctcctgccgctggccttgctgctccacgccgccaggccggacatccagctgacacagagccctgatagcctggccgtgtctctgggagagagagccaccatcaactgcaagagcagccagagcgtgctgtactccagcatcaacaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagcaccccttacaccttcggccagggcaccaaggtggaaatcaaaggcggaggcggaagtggaggcggaggatctggcggcggaggctctcaaatgcagctggtgcagagcggcaccgaagtgaagaagcctggcgagagcctgaagatcagctgcaaaggctccggctacggcttcatcacctactggatcggctgggtccgacagatgcctggcaaaggactggaatggatgggcatcatctaccccggcgacagcgagacaagatacagccctagcttccagggccaagtgaccatcagcgccgacaagagcatcaataccgcctacctccagtggtccagcctgaaggcttctgacaccgccatctactactgtgccggcggaagcggcatcagcaccccaatggatgtttggggccagggaaccaccgtgacagttacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1134 - DNA, 2175 bp, Artificial Sequence
  Synthetic Polynucleotide
atggccttaccagtgaccgccttgctcctgccgctggccttgctgctccacgccgccaggccggacatccagatgacacagagccctctgagcctgcctgtgacacctggcgaacctgccagcatcagctgtagaagcagccagagcctgctggacagcgacgacggcaatacctacctggactggtatctccagaagcctggacagagcccacagctgctgatctacaccctgagctacagagccagcggcgtgcccgatagattttctggctctggcagcggcaccgacttcaccctgaagattagcagagtggaagccgaggacgtgggcgtgtactactgtatgcagcggatcgagttccctctgacctttggcggcggaacaaaggtggaaatcaaaggcggaggcggaagtggaggcggaggatctggcggcggaggctctcaagttcagctggttcagagcggagccgaagtgaagaaacctggggcctctgtgaaggtgtcctgcaaggccagcggctacacctttaccggctactacatgcactgggtccgacaggctccaggccaaggacttgagtggatgggcagaatcaaccccaatagcggcggcaccaactacgcccagaaattccagggcagagtgaccatgaccagagacaccagcatctccaccgcctacatggaactgagccggctgagatccgatgacaccgccgtgtactattgcgccagagtgccttactgctccagcaccagctgccacagagactggtacttcgacctgtggggcagaggcacactggtcacagtctcttctacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1135 - DNA, 2127 bp, Artificial Sequence
  Synthetic Polynucleotide
atggccttaccagtgaccgccttgctcctgccgctggccttgctgctccacgccgccaggccggacatcgtgatgactcagagccccagctttctgagcgccagcgtgggagacagagtgaccatcacatgtagagccagccagggcatcagcagctacctggcttggtatcagcagaagcctggcaaggcccctaaactgctgatctacgccgccagcacactccagtctggcgtgccaagcagattttctggcagcggctctggcaccgagttcaccctgacaatatccagcctccagcctgaggacttcgccacctactactgccagcagctgaacagctaccctccttacacattcggccagggcaccaagctggaaatcaaaggcggaggcggaagtggaggcggaggatctggcggcggaggctctgaagtgcagctggttgaatcaggtggcggcctggttcaacctggcggatctctgagactgagctgtgccgcctctggcttcatcgtgtccagcaactacatgagctgggtccgacaggcccctggcaaaggacttgaatgggtgtccgtgatctacagcggcggcagcacctattacgccgactctgtgaagggcagattcaccatcagccggcacaacagcaagaacaccctgtacctccagatgaacagcctgagagccgaggacaccgccgtgtactactgtgccagagaagcctacggcatggacgtgtggggacagggaacaaccgtgaccgttagctctacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1136 - DNA, 2244 bp, Artificial Sequence
  Synthetic Polynucleotide
atgccacctcctcgcctcctcttcttcctcctcttcctcacccccatggaagtcaggcccgactacaaggacgacgatgacaaggaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgaaatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctcgagatcactgctcggccagtactatggcactggctgctgaggactggtggctggacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1137 - DNA, 2106 bp, Artificial Sequence
  Synthetic Polynucleotide
atgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1138 - DNA, 1581 bp, Artificial Sequence
  Synthetic Polynucleotide
atggccttaccagtgaccgccttgctcctgccgctggccttgctgctccacgccgccaggccgttcgaaatgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1139 - DNA, 2121 bp, Artificial Sequence
  Synthetic Polynucleotide
atggccttaccagtgaccgccttgctcctgccgctggccttgctgctccacgccgccaggccgtggtctcatccccagtttgaaaagggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1140 - DNA, 2097 bp, Artificial Sequence
  Synthetic Polynucleotide
atggccttaccagtgaccgccttgctcctgccgctggccttgctgctccacgccgccaggccgggcagcggcgaattcagagtgcagcctaccgagagcatcgtgcggttccccaacatcaccaatctgtgccctttcggcgaggtgttcaacgccaccagattcgcctctgtgtacgcctggaaccggaagcggatcagcaactgcgtggccgattacagcgtgctgtacaacagcgccagcttcagcaccttcaagtgctacggcgtgtcccctaccaagctgaacgacctgtgcttcaccaacgtgtacgccgacagcttcgtgatcagaggcgacgaagtgcggcagattgcccctggacagacaggcaagatcgccgactacaactacaagctgcccgacgacttcaccggctgtgtgattgcctggaacagcaacaacctggacagcaaagtcggcggcaactacaattacctgtaccggctgtttcggaagtccaacctgaagcctttcgagcgggacatcagcaccgaaatctaccaggccggcagcaccccttgcaatggcgtggaaggcttcaactgctacttcccactgcaaagctacggcttccagcctacaaacggcgtgggctaccagccttacagagtggtggtgctgagcttcgagctgctgcacgctcctgctacagtgtgcggccctaagaaaagcaccaacctggtcaagaacaaatgcgtgaacttcacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1141 - DNA, 2748 bp, Artificial Sequence
  Synthetic Polynucleotide
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaaacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1142 - DNA, 2607 bp, Artificial Sequence
  Synthetic Polynucleotide
atgtctgataatggaccccaaaatcagcgaaatgcaccccgcattacgtttggtggaccctcagattcaactggcagtaaccagaatggagaacgcagtggggcgcgatcaaaacaacgtcggccccaaggtttacccaataatactgcgtcttggttcaccgctctcactcaacatggcaaggaagaccttaaattccctcgaggacaaggcgttccaattaacaccaatagcagtccagatgaccaaattggctactaccgaagagctaccagacgaattcgtggtggtgacggtaaaatgaaagatctcagtccaagatggtatttctactacctaggaactgggccagaagctggacttccctatggtgctaacaaagacggcatcatatgggttgcaactgagggagccttgaatacaccaaaagatcacattggcacccgcaatcctgctaacaatgctgcaatcgtgctacaacttcctcaaggaacaacattgccaaaaggcttctacgcagaagggagcagaggcggcagtcaagcctcttctcgttcctcatcacgtagtcgcaacagttcaagaaattcaactccaggcagcagtaggggaacttctcctgctagaatggctggcaatggcggtgatgctgctcttgctttgctgctgcttgacagattgaaccagcttgagagcaaaatgtctggtaaaggccaacaacaacaaggccaaactgtcactaagaaatctgctgctgaggcttctaagaagcctcggcaaaaacgtactgccactaaagcatacaatgtaacacaagctttcggcagacgtggtccagaacaaacccaaggaaattttggggaccaggaactaatcagacaaggaactgattacaaacattggccgcaaattgcacaatttgcccccagcgcttcagcgttcttcggaatgtcgcgcattggcatggaagtcacaccttcgggaacgtggttgacctacacaggtgccatcaaattggatgacaaagatccaaatttcaaagatcaagtcattttgctgaataagcatattgacgcatacaaaacattcccaccaacagagcctaaaaaggacaaaaagaagaaggctgatgaaactcaagccttaccgcagagacagaagaaacagcaaactgtgactcttcttcctgctgcagatttggatgatttctccaaacaattgcaacaatccatgagcagtgctgactcaactcaggccacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcacactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1143 - DNA, 1503 bp, Artificial Sequence
  Synthetic Polynucleotide
atggatttgtttatgagaatcttcacaattggaactgtaactttgaagcaaggtgaaatcaaggatgctactccttcagattttgttcgcgctactgcaacgataccgatacaagcctcactccctttcggatggcttattgttggcgttgcacttcttgctgtttttcagagcgcttccaaaatcataaccctcaaaaagagatggcaactagcactctccaagggtgttcactttgtttgcaacttgctgttgttgtttgtaacagtttactcacaccttttgctcgttgctgctggccttgaagccccttttctctatctttatgctttagtctacttcttgcagagtataaactttgtaagaataataatgaggctttggctttgctggaaatgccgttccaaaaacccattactttatgatgccaactattttctttgctggcatactaattgttacgactattgtataccttacaatagtgtaacttcttcaattgtcattacttcaggtgatggcacaacaagtcctatttctgaacatgactaccagattggtggttatactgaaaaatgggaatctggagtaaaagactgtgttgtattacacagttacttcacttcagactattaccagctgtactcaactcaattgagtacagacactggtgttgaacatgttaccttcttcatctacaataaaattgttgatgagcctgaagaacatgtccaaattcacacaatcgacggttcatccggagttgttaatccagtaatggaaccaatttatgatgaaccgacgacgactactagcgtgcctttgacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1144 - DNA, 2898 bp, Artificial Sequence
  Synthetic Polynucleotide
atgtcaagctcttcctggctccttctcagccttgttgctgtaactgctgctcagtccaccattgaggaacaggccaagacatttttggacaagtttaaccacgaagccgaagacctgttctatcaaagttcacttgcttcttggaattataacaccaatattactgaagagaatgtccaaaacatgaataatgctggggacaaatggtctgcctttttaaaggaacagtccacacttgcccaaatgtatccactacaagaaattcagaatctcacagtcaagcttcagctgcaggctcttcagcaaaatgggtcttcagtgctctcagaagacaagagcaaacggttgaacacaattctaaatacaatgagcaccatctacagtactggaaaagtttgtaacccagataatccacaagaatgcttattacttgaaccaggtttgaatgaaataatggcaaacagtttagactacaatgagaggctctgggcttgggaaagctggagatctgaggtcggcaagcagctgaggccattatatgaagagtatgtggtcttgaaaaatgagatggcaagagcaaatcattatgaggactatggggattattggagaggagactatgaagtaaatggggtagatggctatgactacagccgcggccagttgattgaagatgtggaacatacctttgaagagattaaaccattatatgaacatcttcatgcctatgtgagggcaaagttgatgaatgcctatccttcctatatcagtccaattggatgcctccctgctcatttgcttggtgatatgtggggtagattttggacaaatctgtactctttgacagttccctttggacagaaaccaaacatagatgttactgatgcaatggtggaccaggcctgggatgcacagagaatattcaaggaggccgagaagttctttgtatctgttggtcttcctaatatgactcaaggattctgggaaaattccatgctaacggacccaggaaatgttcagaaagcagtctgccatcccacagcttgggacctggggaagggcgacttcaggatccttatgtgcacaaaggtgacaatggacgacttcctgacagctcatcatgagatggggcatatccagtatgatatggcatatgctgcacaaccttttctgctaagaaatggagctaatgaaggattccatgaagctgttggggaaatcatgtcactttctgcagccacacctaagcatttaaaatccattggtcttctgtcacccgattttcaagaagacaatgaaacagaaataaacttcctgctcaaacaagcactcacgattgttgggactctgccatttacttacatgttagagaagtggaggtggatggtctttaaaggggaaattcccaaagaccagtggatgaaaaagtggtgggagatgaagcgagagatagttggggtggtggaacctgtgccccatgatgaaacatactgtgaccccgcatctctgttccatgtttctaatgattactcattcattcgatattacacaaggaccctttaccaattccagtttcaagaagcactttgtcaagcagctaaacatgaaggccctctgcacaaatgtgacatctcaaactctacagaagctggacagaaactgttcaatatgctgaggcttggaaaatcagaaccctggaccctagcattggaaaatgttgtaggagcaaagaacatgaatgtaaggccactgctcaactactttgagcccttatttacctggctgaaagaccagaacaagaattcttttgtgggatggagtaccgactggagtccatatgcagaccaaagcatcaaagtgaggataagcctaaaatcagctcttggagataaagcatatgaatggaacgacaatgaaatgtacctgttccgatcatctgttgcatatgctatgaggcagtactttttaaaagtaaaaaatcagatgattctttttggggaggaggatgtgcgagtggctaatttgaaaccaagaatctcctttaatttctttgtcactgcacctaaaaatgtgtctgatatcattcctagaactgaagttgaaaaggccatcaggatgtcccggagccgtatcaatgatgctttccgtctgaatgacaacagcctagagtttctggggatacagccaacacttggacctcctaaccagccccctgtttccacgcgtggaggcagtggtaaccccaccgtgaacaacgacgtgaaccggggcaagatgcccggcaagaaactgcccctggaagtgctgatcgagctggaagccaacgccttcaaggccggctgcaccagaggctgcctgatctgcctgagcaagatcaagtgtaccgccaagatgaagcagtacatccccggcagatgccacgactacggcggcgacaagaaaacaggccaggccggaatcgtgggagccatcgtggacatccctgagatcagcggcttcaaagagatggaacccctggaacagtttatcgcccaggtggacctgtgcgccgattgcacaaccggctgtctgaagggcctggctaacgtgaagtgcagcgagctgctgaagaagtggctgcccgacagatgcgccagcttcgccgacaagatccagaaagaggcccacaacatcaagggactggccggcgacagactcgagggaggcagctggagccaccctcagtttgaaaaagactacaaagacgatgacgataagggatcagattacaaggatgatgatgacaaggggtcagattataaagacgacgatgataaagggagcgactacaaggacgacgatgacaaggcctggtcccatccccagttcgagaaacaccatcaccaccaccatcatcac

SEQ ID NO: 1145-1154 - skipped (10 entries)

SEQ ID NO: 1155 - DNA, 24 bp, Artificial Sequence
  Synthetic Polynucleotide
gggggggggggggggggggggggg

SEQ ID NO: 1156-1160 - skipped (5 entries)

SEQ ID NO: 1161 - protein, 107 aa, Artificial Sequence
  Sythetic Polypeptide
GVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1162 - protein, 23 aa, Artificial Sequence
  Sythetic Polypeptide
FQCNQCGASFTQKGNLLRHIKLH

SEQ ID NO: 1163 - protein, 53 aa, Artificial Sequence
  Sythetic Polypeptide
FQCNQCGASFTQKGNLLRHIKLHSGEKPFKCHLCNYACRRRDALTGHLRTHSV

SEQ ID NO: 1164 - protein, 99 aa, Artificial Sequence
  Sythetic Polypeptide
FQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1165 - protein, 168 aa, Artificial Sequence
  Sythetic Polypeptide
GKFQCNQCGASFTQNVLMVHKRSHTGERPFQCNQCGASFTQKGNLLRHIKLHSGEKPFQCNQCGASFTQRRDALTGHLRTHSVRPFQCNQCGASFTQKGNLLRHIKLHSGEKPFQCNQCGASFTQKGNLLRHIKLHSGEKPFQCNQCGASFTQKGNLLRHIKLHSGEK

SEQ ID NO: 1166 - skipped

SEQ ID NO: 1167 - protein, 2276 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQARAKRSGSGQCTNYALLKLAGDVESNPGPMDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPL

SEQ ID NO: 1168 - protein, 1030 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1169 - protein, 1973 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1170 - protein, 862 aa, Artificial Sequence
  Sythetic Polypeptide
MYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1171 - protein, 939 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGASMYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1172 - protein, 935 aa, Artificial Sequence
  Sythetic Polypeptide
MYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1173 - protein, 1010 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGMYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQA

SEQ ID NO: 1174 - protein, 331 aa, Artificial Sequence
  Sythetic Polypeptide
MRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1175 - protein, 12 aa, Artificial Sequence
  Sythetic Polypeptide
SRBDIKZFZFZF

SEQ ID NO: 1176 - protein, 1380 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1177 - protein, 1374 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1178 - protein, 528 aa, Artificial Sequence
  Sythetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1179 - protein, 520 aa, Artificial Sequence
  Sythetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1180 - protein, 331 aa, Artificial Sequence
  Sythetic Polypeptide
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQGSGVQVETISPGDGRTFPKRGQTCVVHYTGMLEDGKKVDSSRDRNKPFKFMLGKQEVIRGWEEGVAQMSVGQRAKLTISPDYAYGATGHPGIIPPHATLVFDVELLKLE

SEQ ID NO: 1181 - protein, 323 aa, Artificial Sequence
  Sythetic Polypeptide
MADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1182 - protein, 1139 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1183 - protein, 1055 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLH

SEQ ID NO: 1184 - protein, 1085 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSV

SEQ ID NO: 1185 - protein, 1131 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRSRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1186 - protein, 2082 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1187 - protein, 971 aa, Artificial Sequence
  Sythetic Polypeptide
MYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1188 - protein, 1048 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGASMYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1189 - protein, 1044 aa, Artificial Sequence
  Sythetic Polypeptide
MYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1190 - protein, 1119 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGMYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGVQVETISPGDGRTFPKRGQTCVVHYTGMLEDGKKGILDSSRDRNKPFKFMLGKQEVIRGWEEGVAQMSVGQRAKLTISPDYAYGATGHPGIIPPHATLVFDVELLKLE

SEQ ID NO: 1191 - protein, 2074 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1192 - protein, 963 aa, Artificial Sequence
  Sythetic Polypeptide
MYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1193 - protein, 1040 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGASMYPYDVPDYAWYLKFLRQYFIAGLIAIVADNIWRLNEVAKNLADNIWNLNESLIDLADKQWRLNQLESKMADNIWGMSRIGMEVADRIWLALLLLDRLADKQYGDAALALLLLADKRWLLLLDRLNQLADNIWTLACFVLAAVADNIYGLMWLSYFIADRIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1194 - protein, 1036 aa, Artificial Sequence
  Sythetic Polypeptide
MYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1195 - protein, 1111 aa, Artificial Sequence
  Sythetic Polypeptide
MQIFVKTLTGKTITLEVEPSDTIENVKAKIQDKEGIPPDQQRLIFAGKQLEDGRTLSDYNIQKESTLHLVLRLRGMYPYDVPDYAWYLKFLRQYIRGWIFGTTLDSKTQSLLADNIWCTFEYVSQPFLMDADNIWQPFLMDLEGKQGNADKQWTRFQTLLALHRSYLTPGDSSSGWADNIWKSFTVEKGIYQTSNFRVQADRIWSASFSTFKCYGVSPTKLADKRWQLIRAAEIRASANLAATKADNIWHWFVTQRNFYEPQIIADNIYNLDSKVGGNYNYLYRLFRADRIWLLNKHIDAYKTFPADNIWRAKRSGSGATNFSLLKQAGDVEENPGPTSMADSNGTITVEELKKLLEQWNLVIGFLFLTWICLLQFAYANRNRFLYIIKLIFLWLLWPVTLACFVLAAVYRINWITGGIAIAMACLVGLMWLSYFIASFRLFARTRSMWSFNPETNILLNVPLHGTILTRPLLESELVIGAVILRGHLRIAGHHLGRCDIKDLPKEITVATSRTLSYYKLGASQRVAGDSGFAAYSRYRIGNYKLNTDHSSSSDNIALLVQRAKRSGSGVKQTLNFDLLKLAGDVESNPGPMSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQAGSFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEE

SEQ ID NO: 1196 - skipped

SEQ ID NO: 1197 - protein, 1079 aa, Artificial Sequence
  Sythetic Polypeptide
MDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1198 - protein, 785 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1199 - protein, 821 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNTRGGSGVFTLEDFVGDWRQTAGYNLDQVLEQGGVSSLFQNLGVSVTPIQRIVLSGENGLKIDIHVIIPYEGLSGDQMGQIEKIFKVVYPVDDHHFKVILHYGTLVIDGVTPNMIDYFGRPYEGIAVFDGKKITVTGTLWNGNKIIDERLINPDGSLLFRVTINGVTGWRLCERILALEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1200 - protein, 330 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRTTTKPVLRTPSPVHPTGTSQPQRPEDCRPRGSVKGTGLDFACDIYIWAPLAGICVAPLLSLIITLICYHRS

SEQ ID NO: 1201 - protein, 732 aa, Artificial Sequence; identical to SEQ ID NO: 708
  Sythetic Polypeptide

SEQ ID NO: 1202 - protein, 733 aa, Artificial Sequence; identical to SEQ ID NO: 709
  Sythetic Polypeptide

SEQ ID NO: 1203 - protein, 742 aa, Artificial Sequence; identical to SEQ ID NO: 710
  Sythetic Polypeptide

SEQ ID NO: 1204 - protein, 726 aa, Artificial Sequence; identical to SEQ ID NO: 711
  Sythetic Polypeptide

SEQ ID NO: 1205 - protein, 765 aa, Artificial Sequence; identical to SEQ ID NO: 713
  Sythetic Polypeptide

SEQ ID NO: 1206 - protein, 719 aa, Artificial Sequence; identical to SEQ ID NO: 714
  Sythetic Polypeptide

SEQ ID NO: 1207 - protein, 544 aa, Artificial Sequence; identical to SEQ ID NO: 715
  Sythetic Polypeptide

SEQ ID NO: 1208 - protein, 724 aa, Artificial Sequence; identical to SEQ ID NO: 716
  Sythetic Polypeptide

SEQ ID NO: 1209 - protein, 716 aa, Artificial Sequence; identical to SEQ ID NO: 717
  Sythetic Polypeptide

SEQ ID NO: 1210 - protein, 934 aa, Artificial Sequence; identical to SEQ ID NO: 718
  Sythetic Polypeptide

SEQ ID NO: 1211 - protein, 886 aa, Artificial Sequence; identical to SEQ ID NO: 719
  Sythetic Polypeptide

SEQ ID NO: 1212 - protein, 519 aa, Artificial Sequence; identical to SEQ ID NO: 720
  Sythetic Polypeptide

SEQ ID NO: 1213 - protein, 984 aa, Artificial Sequence; identical to SEQ ID NO: 721
  Sythetic Polypeptide

SEQ ID NO: 1214 - skipped

SEQ ID NO: 1215 - protein, 1077 aa, Artificial Sequence
  Sythetic Polypeptide
MDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1216 - protein, 783 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1217 - protein, 819 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1218 - protein, 730 aa, Artificial Sequence
  Sythetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1219 - protein, 731 aa, Artificial Sequence
  Sythetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1220 - protein, 740 aa, Artificial Sequence
  Sythetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1221 - protein, 724 aa, Artificial Sequence
  Sythetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1222 - protein, 763 aa, Artificial Sequence
  Sythetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1223 - protein, 717 aa, Artificial Sequence
  Sythetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1224 - protein, 542 aa, Artificial Sequence
  Sythetic Polypeptide
MALPVTALLLPLALLLHAARPFEMLQMAGQCSQNEYFDSLLHACIPCQLRCSSNTPPLTCQRYCNASVTNSVKGTNATRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1225 - protein, 722 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1226 - protein, 714 aa, Artificial Sequence
  Sythetic Polypeptide
MALPVTALLLPLALLLHAARPGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1227 - protein, 932 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHH

SEQ ID NO: 1228 - protein, 884 aa, Artificial Sequence
  Sythetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQATRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1229 - protein, 517 aa, Artificial Sequence
  Sythetic Polypeptide
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPLTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHH

SEQ ID NO: 1230 - protein, 982 aa, Artificial Sequence
  Sythetic Polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTRGGSGKPTENNEDFNIVAVASNFATTDLDADRGKLPGKKLPLEVLKEMEANARKAGCTRGCLICLSHIKCTPKMKKFIPGRCHTYEGDKESAQGGIGEAIVDIPEIPGFKDLEPMEQFIAQVDLCVDCTTGCLKGLANVQCSDLLKKWLPQRCATFASKIQGQVDKIKGAGGDLEGGSWSHPQFEKDYKDDDDKGSDYKDDDDKGSDYKDDDDKGSDYKDDDDKAWSHPQFEKHHHHHHHH

SEQ ID NO: 1231 - skipped

SEQ ID NO: 1232 - protein, 1056 aa, Artificial Sequence
  Sythetic Polypeptide
MDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1233 - protein, 762 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1234 - protein, 798 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1235 - protein, 709 aa, Artificial Sequence
  Sythetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1236 - protein, 710 aa, Artificial Sequence
  Sythetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1237 - protein, 719 aa, Artificial Sequence
  Sythetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1238 - protein, 703 aa, Artificial Sequence
  Sythetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1239 - protein, 742 aa, Artificial Sequence
  Sythetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1240 - protein, 696 aa, Artificial Sequence
  Sythetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1241 - protein, 521 aa, Artificial Sequence
  Sythetic Polypeptide
MALPVTALLLPLALLLHAARPFEMLQMAGQCSQNEYFDSLLHACIPCQLRCSSNTPPLTCQRYCNASVTNSVKGTNATRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1242 - protein, 701 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1243 - protein, 693 aa, Artificial Sequence
  Sythetic Polypeptide
MALPVTALLLPLALLLHAARPGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1244 - protein, 911 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHH

SEQ ID NO: 1245 - protein, 863 aa, Artificial Sequence
  Sythetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQATRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1246 - protein, 496 aa, Artificial Sequence
  Sythetic Polypeptide
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPLTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHH

SEQ ID NO: 1247 - protein, 961 aa, Artificial Sequence
  Sythetic Polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTRGGSGEAEAERGKLPGKKLPLEVLIELEANARKAGCTRGCLICLSKIKCTAKMKKYIPGRCADYGGDKKTGQAGIVGAIVDIPEISGFKEMEPMEQFIAQVDRCADCTTGCLKGLANVKCSDLLKKWLPGRCATFADKIQSEVDNIKGLAGDLEGGSWSHPQFEKDYKDDDDKGSDYKDDDDKGSDYKDDDDKGSDYKDDDDKAWSHPQFEKHHHHHHHH

SEQ ID NO: 1248 - skipped

SEQ ID NO: 1249 - protein, 1061 aa, Artificial Sequence
  Sythetic Polypeptide
MDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYTTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1250 - protein, 767 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1251 - protein, 803 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1252 - protein, 714 aa, Artificial Sequence
  Sythetic Polypeptide
MALPVTALLLPLALLLHAARPDIQMTQSPSSLSASVGDRVTITCKASDHINNWLAWYQQKPGQAPKLLIYGATTLETGVPSRFSGSGSGTDYTLTISSLQPEDFATYYCQQSWNTPWTFGQGTKLEIKRGGGGSGGGGSGGGGSQVQLQQPGAELVKPGASVKMSCKASGYAFSSYWINWMKQKPGQGLEWIGQIYPGDGDTNYNGKFKGRATLTADTSSSTAYMQLSSLTSEDSAVYFCARSITTVVGCAMDYWGQGTSVTVSSTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1253 - protein, 715 aa, Artificial Sequence
  Sythetic Polypeptide
MALPVTALLLPLALLLHAARPDIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIKGGGGSGGGGSGGGGSQMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTVTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1254 - protein, 724 aa, Artificial Sequence
  Sythetic Polypeptide
MALPVTALLLPLALLLHAARPDIQMTQSPLSLPVTPGEPASISCRSSQSLLDSDDGNTYLDWYLQKPGQSPQLLIYTLSYRASGVPDRFSGSGSGTDFTLKISRVEAEDVGVYYCMQRIEFPLTFGGGTKVEIKGGGGSGGGGSGGGGSQVQLVQSGAEVKKPGASVKVSCKASGYTFTGYYMHWVRQAPGQGLEWMGRINPNSGGTNYAQKFQGRVTMTRDTSISTAYMELSRLRSDDTAVYYCARVPYCSSTSCHRDWYFDLWGRGTLVTVSSTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1255 - protein, 708 aa, Artificial Sequence
  Sythetic Polypeptide
MALPVTALLLPLALLLHAARPDIVMTQSPSFLSASVGDRVTITCRASQGISSYLAWYQQKPGKAPKLLIYAASTLQSGVPSRFSGSGSGTEFTLTISSLQPEDFATYYCQQLNSYPPYTFGQGTKLEIKGGGGSGGGGSGGGGSEVQLVESGGGLVQPGGSLRLSCAASGFIVSSNYMSWVRQAPGKGLEWVSVIYSGGSTYYADSVKGRFTISRHNSKNTLYLQMNSLRAEDTAVYYCAREAYGMDVWGQGTTVTVSSTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1256 - protein, 747 aa, Artificial Sequence
  Sythetic Polypeptide
MPPPRLLFFLLFLTPMEVRPDYKDDDDKEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1257 - protein, 701 aa, Artificial Sequence
  Sythetic Polypeptide
MPLLLLLPLLWAGALAMDPNFWLQVQESVTVQEGLCVLVPCTFFHPIPYYDKNSPVHGYWFREGAIISGDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1258 - protein, 526 aa, Artificial Sequence
  Sythetic Polypeptide
MALPVTALLLPLALLLHAARPFEMLQMAGQCSQNEYFDSLLHACIPCQLRCSSNTPPLTCQRYCNASVTNSVKGTNATRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1259 - protein, 706 aa, Artificial Sequence
  Sythetic Polypeptide
MALPVTALLLPLALLLHAARPWSHPQFEKGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1260 - protein, 698 aa, Artificial Sequence
  Sythetic Polypeptide
MALPVTALLLPLALLLHAARPGSGEFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1261 - protein, 916 aa, Artificial Sequence
  Sythetic Polypeptide
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHH

SEQ ID NO: 1262 - protein, 868 aa, Artificial Sequence
  Sythetic Polypeptide
MSDNGPQNQRNAPRITFGGPSDSTGSNQNGERSGARSKQRRPQGLPNNTASWFTALTQHGKEDLKFPRGQGVPINTNSSPDDQIGYYRRATRRIRGGDGKMKDLSPRWYFYYLGTGPEAGLPYGANKDGIIWVATEGALNTPKDHIGTRNPANNAAIVLQLPQGTTLPKGFYAEGSRGGSQASSRSSSRSRNSSRNSTPGSSRGTSPARMAGNGGDAALALLLLDRLNQLESKMSGKGQQQQGQTVTKKSAAEASKKPRQKRTATKAYNVTQAFGRRGPEQTQGNFGDQELIRQGTDYKHWPQIAQFAPSASAFFGMSRIGMEVTPSGTWLTYTGAIKLDDKDPNFKDQVILLNKHIDAYKTFPPTEPKKDKKKKADETQALPQRQKKQQTVTLLPAADLDDFSKQLQQSMSSADSTQATRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHHTSGSGEGRGSLLTCGDVEENPGPHMTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 1263 - protein, 501 aa, Artificial Sequence
  Sythetic Polypeptide
MDLFMRIFTIGTVTLKQGEIKDATPSDFVRATATIPIQASLPFGWLIVGVALLAVFQSASKIITLKKRWQLALSKGVHFVCNLLLLFVTVYSHLLLVAAGLEAPFLYLYALVYFLQSINFVRIIMRLWLCWKCRSKNPLLYDANYFLCWHTNCYDYCIPYNSVTSSIVITSGDGTTSPISEHDYQIGGYTEKWESGVKDCVVLHSYFTSDYYQLYSTQLSTDTGVEHVTFFIYNKIVDEPEEHVQIHTIDGSSGVVNPVMEPIYDEPTTTTSVPLTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHH

SEQ ID NO: 1264 - protein, 966 aa, Artificial Sequence
  Sythetic Polypeptide
MSSSSWLLLSLVAVTAAQSTIEEQAKTFLDKFNHEAEDLFYQSSLASWNYNTNITEENVQNMNNAGDKWSAFLKEQSTLAQMYPLQEIQNLTVKLQLQALQQNGSSVLSEDKSKRLNTILNTMSTIYSTGKVCNPDNPQECLLLEPGLNEIMANSLDYNERLWAWESWRSEVGKQLRPLYEEYVVLKNEMARANHYEDYGDYWRGDYEVNGVDGYDYSRGQLIEDVEHTFEEIKPLYEHLHAYVRAKLMNAYPSYISPIGCLPAHLLGDMWGRFWTNLYSLTVPFGQKPNIDVTDAMVDQAWDAQRIFKEAEKFFVSVGLPNMTQGFWENSMLTDPGNVQKAVCHPTAWDLGKGDFRILMCTKVTMDDFLTAHHEMGHIQYDMAYAAQPFLLRNGANEGFHEAVGEIMSLSAATPKHLKSIGLLSPDFQEDNETEINFLLKQALTIVGTLPFTYMLEKWRWMVFKGEIPKDQWMKKWWEMKREIVGVVEPVPHDETYCDPASLFHVSNDYSFIRYYTRTLYQFQFQEALCQAAKHEGPLHKCDISNSTEAGQKLFNMLRLGKSEPWTLALENVVGAKNMNVRPLLNYFEPLFTWLKDQNKNSFVGWSTDWSPYADQSIKVRISLKSALGDKAYEWNDNEMYLFRSSVAYAMRQYFLKVKNQMILFGEEDVRVANLKPRISFNFFVTAPKNVSDIIPRTEVEKAIRMSRSRINDAFRLNDNSLEFLGIQPTLGPPNQPPVSTRGGSGNPTVNNDVNRGKMPGKKLPLEVLIELEANAFKAGCTRGCLICLSKIKCTAKMKQYIPGRCHDYGGDKKTGQAGIVGAIVDIPEISGFKEMEPLEQFIAQVDLCADCTTGCLKGLANVKCSELLKKWLPDRCASFADKIQKEAHNIKGLAGDRLEGGSWSHPQFEKDYKDDDDKGSDYKDDDDKGSDYKDDDDKGSDYKDDDDKAWSHPQFEKHHHHHHHH

What is claimed is:

1. A method of generating an adoptive cell therapy composition comprising:
    transducing T cells that express a T-cell receptor that specifically binds to a SARS-cov2 encoded first antigen with a nucleic acid encoding at least one synthetic antigen binding receptor (SABR) specific for binding to a second antigen selected from the group consisting of a cell surface marker, a cancer cell-associated antigen, a tumor antigen, an autoimmune-associated antigen, a differentiation antigen, an over-expressed embryonic antigen, a mutated tumor suppressor gene and a tumor antigen resulting from chromosomal translocation.

2. A method of generating an adoptive cell therapy composition comprising: transducing allogeneic or autologous T cells that express a T cell receptor that specifically binds to a SARS-cov2-encoded first antigen presented on a major histocompatibility complex (MHC) with a vector comprising a nucleic acid encoding a synthetic antigen binding receptor (SABR) that specifically binds to a second antigen, wherein the second antigen is a target-cell antigen or a cell surface marker.

3. The method of claim 1 or 2, wherein said second antigen is selected from the group consisting of CD5; CD19; CD123; CD22; CD30; CD171; CS 1; CD33; epidermal growth factor receptor variant III (EGFRviii); ganglioside G2 (GD2); ganglioside GD3 (aNeu5Ac (2-8) aNeu5Ac (2-3) bDGalp (1-4) bDG1cp (1-1) Cer); TNF receptor family member B cell maturation (BCMA); Tn antigen; prostate-specific membrane antigen (PSMA); Receptor tyrosine kinase-like orphan receptor 1 (ROR1); Fms Like Tyrosine Kinase 3 (FL T3); Tumor-associated glycoprotein 72 (TAG72); CD38; CD44v6; a glycosylated CD43 epitope expressed on acute leukemia or lymphoma but not on hematopoietic progenitors; a glycosylated CD43 epitope expressed on nonhematopoietic cancers; Carcinoembryonic antigen (CEA); Epithelial cell adhesion molecule (EP-CAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Folate receptor beta (FRb); Receptor tyrosine-protein kinase ERBB2; Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin 82; fibroblast activation protein alpha; insulin-like growth factor 1 receptor (IGF-1 receptor); carbonic anhydrase IX (CAIX); Proteasome Subunit, Beta Type, 9; glycoprotein 100 (gp100); oncogene fusion protein consisting of breakpoint cluster region (BCR) and Abelson murine leukemia viral oncogene homolog 1 (Abl) (bcrabl); tyrosinase; ephrin type-A receptor 2 (EphA2); sialyl Lewis adhesion molecule (sle); ganglioside GM3 (aNeuSAc (2-3) bDClalpd-4) bDGlcp (-1) Cer); transglutaminase 5 (TGS5); high molecular weight-melanoma associated antigen (HMWMAA); o-acetyl-GD2 ganglioside (OAcGD2); tumor endothelial marker 1 (TEM 1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen NY-BR-1 (NY-BR-1); uroplakin 2 (UPK2); adrenoceptor beta 3 (ADRB3); pannexin 3 (PANX3); G protein-coupled receptor 20 (GPR20); lymphocyte antigen 6 complex, locus K 9 (L Y6K); Olfactory receptor 51 E2 (OR51 E2); TCR Gamma Alternate Reading Frame Protein (TARP); Wilms tumor protein (WT1); Cancer/testis antigen 1; Cancer/testis antigen 2; Melanoma-associated antigen 1 (MAGE-A 1); ETS translocation-variant gene 6, located on chromosome 12p (ETV6-AML); sperm protein 17 (SPA17); X Antigen Family, Member IA; angiopoietin-binding cell surface receptor 2 (Tie 2); melanoma cancer testis antigen-1; melanoma cancer testis antigen-2; Fos-related antigen 1; tumor protein p53 (p53); p53 mutant; prostein; survivin; telomerase; prostate carcinoma tumor antigen-1; melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); transmembrane protease, serine 2 (TMPRSS2) ETS fusion gene; N-Acetyl glucosaminyl-transferase V; paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPIB 1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32; lymphocyte-specific protein tyrosine kinase (LCK); A kinase anchor protein 4 (AKAP-4); synovial sarcoma, X breakpoint 2 (SSX2); Receptor for Advanced Glycation Endproducts; renal ubiquitous 1 (RU1); renal ubiquitous 2 (RU2); legumain; intestinal carboxyl esterase; heat shock protein 70-2 mutated; CD79a; CD79b; CD72; Leukocyte-associated immunoglobulin-like receptor 1 (LAI R 1; Fc fragment of IgA receptor; Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); immunoglobulin lambda-like polypeptide 1 (IGLL 1), MPL; Biotin; c-MYC epitope Tag; CD34; LAMP1; TROP2; GFRalpha4; CDH17; CDH6; NYBR1; CDH19; CD200R; Slea; Fucosyl-GM1; PTK7; gpNMB; CDH1-CD324; DLL3; CD276/B7H3; IL 11 Ra; IL 13Ra2; CD179b-IGLII; TCR-gamma-delta; NKG2D; CD32; Tim1-/HVCR1; CSF2RA; TGFbetaR2; Lews Ag, TCR-beta1 chain; TCR-beta2 chain; TCR-gamma chain; TCR-delta chain; FITC; Luteinizing hormone receptor (LHR); Follicle stimulating hormone receptor (FSHR); Gonadotropin Hormone receptor; CCR4; GD3; SLAMF6; SLAMF4; HIV1 envelope glycoprotein; HTLV1-Tax; CMV pp65; EBVEBNA3c; KSHV K8.1; KSHV-gH; GAD; PDL 1; Guanylyl cyclase C (GCC); auto antibody to desmoglein 3 (Dsg3); auto antibody to desmoglein 1 (Dsg1); HLA, HLA-A; HLA-A2; HLA-B; HLA-C; HLA-DP; HLA-DM; HLA-DOA; HLA-008HLA-DOB; HLA-DQ; HLA-DR; HLA-G; IgE; CD99; Ras G12V; Tissue Factor 1 (TF1); AFP; GPRC5D; Claudin18.2; P-glycoprotein; STEAP1; Liv1; Nectin-4; Cripto; gpA33; BST1/CD157; low conductance chloride channel; the antigen recognized by TNT antibody; CD229; Toso; and BAFF-R.

4. The method of claim 1, wherein the nucleic acid encoding the SABR is introduced into T cells using a vector, wherein optionally the vector is a retroviral vector, a lentiviral vector, or an in vitro transcribed RNA vector.

5. The method of claim 1, wherein SARS-cov2 is the etiological agent of coronavirus disease 2019 (COVID-19) or a variant thereof.

6. The method of claim 1, wherein the SARS-cov2 peptide antigen is comprised of at least 5 but no more than 25 contiguous amino acids sequence of any SARS-cov2 viral protein or a variant thereof.

7. The method of claim 6, wherein the SARS-cov2 peptide antigen is selected from one or more of the following:
 a) a sequence of at least 5 but no more than 25 contiguous amino acids derived from one or more of SEQ ID NO: 694, 700-703, 707, or 712, or a variant with at least 80% sequence homology thereof; and/or
 b) a sequence with at least 80% homology to a peptide sequence selected from SEQ ID NO: 980-1028; and/or
 c) a sequence with up to 3 conservative substitutions in a peptide sequence selected from SEQ ID NO: 980-1028.

8. The method of claim 1, wherein the T cells are obtained from a SARS-cov2-immune or a SARS-cov2-positive subject.

9. The method of claim 8, wherein the SARS-cov2-immune or a SARS-cov2-positive subject has one or more of the following characteristics:
 (a) evidence of cellular and/or humoral immunity to SARS-cov2;
 (b) a history of infection with SARS-cov2;
 (c) history of having received a SARS-cov2 vaccine;
 (d) history of receiving one or more SARS-cov2 vaccine booster dose;
 (e) T cells that recognize one or more antigens encoded by SARS-cov2 wherein the level of the SARS-cov2 specific T cells is at least 20% higher than a subject who is not SARS-cov2 immune and/or is in the top 20, 30, 40, 50, 60, 70, 80 or 90 percentile of the SARS-cov2 immune subjects; and/or
 (f) antibodies against one or more antigens encoded by SARS-cov2; wherein the level of the SARS-cov2 antibodies is at least 20% higher than a subject who is not SARS-cov2 immune and/or is in the top 20, 30, 40, 50, 60, 70, 80 or 90 percentile of the SARS-cov2 immune subjects.

10. The method of claim 1, wherein the T cells are selected from the group consisting of CD8+ T cells, CD4+ T cells, TREGs, cytotoxic T cells, NKT cells, naïve T cells, central memory T cells, effector memory T cells, stem memory T cells (Tscm), iPSC-derived T cells and synthetic T cells.

11. The method of claim 1, wherein the T cells have one or more of the features selected from the group consisting of:
 (a) lacks the expression of one or more of endogenous T cell receptor chains;
 (b) lacks the expression of constant chains of endogenous T cell receptor $\alpha$, $\beta1$, $\beta2$, pre-TCR$\alpha$, $\gamma$ or $\delta$ or combination thereof;
 (c) lacks the expression of HLA;
 (d) lacks the expression of $\beta2$ microglobulin;
 (e) lacks the expression of CD52;
 (f) expresses an agent which enhances the activity of a SABR-expressing cell;
 (g) expresses an agent that provides co-stimulation to a SABR-expressing cell;
 (h) expresses a cytokine or a chemokine;
 (i) expresses an agent that that promotes the proliferation, persistence, expansion and/or activation of a SABR-expressing cell;
 (j) expresses an agent which increases the expression and/or activity of SABR chains;
 (k) expresses a soluble receptor;
 (l) expresses a second SABR;
 (m) expresses an inhibitory SABR that comprises an antigen binding domain, a transmembrane domain and an intracellular domain of an inhibitory molecule;
 (n) expresses a second SABR comprising an antigen binding domain, a transmembrane domain and a primary signaling domain;
 (o) expresses a second SABR comprising an antigen binding domain, a transmembrane domain, a costimulatory signaling domain but no primary signaling domain;
 (p) expresses a second SABR comprising an antigen binding domain, a transmembrane domain, a primary signaling domain and a costimulatory domain;
 (q) expresses an accessory module which increases, decreases, regulates or modifies the expression or activity of a SABR or a SABR-expressing cell, wherein the accessory module is selected from the group consisting of POL 1, PDL2, CD80, CD86, NEMO-K277A, K13-opt, MyD88, 41BBL, vFLIPK13, IL-7, IL-15, IL-21, and any combination thereof; and/or
 (r) expresses a therapeutic control selected from the group consisting of CNB30, a truncated epidermal growth factor receptor (tEGFR), truncated epidermal growth factor receptor viii (tEGFRviii), truncated CD 19 (tCD 19), truncated BCMA (tBCMA), icaspase-9 and an antibiotic resistance cassette.

12. The method of claim 1, wherein the SABR comprises:
 (a) at least one antigen binding domain and at least one transmembrane or a membrane anchoring domain; and/or
 (b) a targeting/binding moiety that is associated with one or more signaling domains.

13. The method of claim 12, wherein the antigen binding domain and/or the targeting moiety of the SABR comprises a member selected from the group consisting of a scFv, a vL, a vH, an antibody, an antibody fragment, an antibody like moiety, a Vα domain, a Vβ domain, a cytokine, a receptor and combination thereof.

14. The method of claim 1, wherein the SABR is selected from the group consisting of a Chimeric Antigen Receptor (CAR), an Antibody-TCR chimeric molecule (Ab-TCR), a TCR receptor fusion protein (TFP), a Synthetic Immune Receptor (SIR), a Tri-functional T cell antigen coupler (Tri-TAC or TAC), a z-SIR, a TRUCK, a Universal SABR, a Self-driving SABR, an Armored SABR, a Self-destruct SABR, a Conditional SABR, a Marked SABR, a Tandem SABR (tanSABR), a Dual SABR, a bispecific-SABR, and a safety SABR (sSABR).

15. The method of claim 1, further comprising a step wherein the T cells are stimulated with antigen presenting cells (APC) presenting SARS-cov2 encoded peptide antigens in vitro and/or in vivo: (a) before transduction with the nucleic acid encoding the SABR; (b) after transduction with the nucleic acid encoding the SABR; or (c) both before and after transduction with the nucleic acid encoding the SABR.

16. A method for generating a composition for the treatment of cancer and/or autoimmune disorders comprising:

transducing T cells that express a T-cell receptor that specifically binds to a SARS-cov2 encoded first antigen with a vector comprising a nucleic acid encoding at least one synthetic antigen binding receptor (SABR) specific for binding to a second antigen selected from the group consisting of CD5; CD19; CD123; CD22; CD30; CD171; CS1; C-type lectin-like molecule-1; CD33; epidermal growth factor receptor variant III (EGFRviii); ganglioside G2 (GD2); ganglioside GD3 (aNeu5Ac (2-8) aNeu5Ac (2-3) bDGalp (1-4) bDG1cp (1-1) Cer); TNF receptor family member B cell maturation (BCMA); Tn antigen; prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors; a glycosylated CD43 epitope expressed on nonhematopoietic cancers; Carcinoembryonic antigen (CEA); Epithelial cell adhesion molecule (EPCAM); B7H3 (CD276); KIT (CD117); Interleukin-13 receptor subunit alpha-2; Mesothelin; Interleukin 11 receptor alpha (IL-11Ra); prostate stem cell antigen (PSCA); Protease Serine 21; vascular endothelial growth factor receptor 2 (VEGFR2); Lewis (Y) antigen; CD24; Platelet-derived growth factor receptor beta (PDGFR-beta); Stage-specific embryonic antigen-4 (SSEA-4); CD20; Folate receptor alpha; Folate receptor beta (FRb); Receptor tyrosine-protein kinase ERBB2; Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin 82; fibroblast activation protein alpha; insulin-like growth factor 1 receptor (IGF-1 receptor); carbonic anhydrase IX (CAIX); Proteasome Subunit, Beta Type, 9; glycoprotein 100 (gp100); oncogene fusion protein consisting of breakpoint cluster region (BCR) and Abelson murine leukemia viral oncogene homolog 1 (Abl) (bcrabl); tyrosinase; ephrin type-A receptor 2 (EphA2); sialyl Lewis adhesion molecule (sLe); ganglioside GM3 (aNeuSAc (2-3) bDClapd-4) bDGlcp(-1) Cer); transglutaminase 5 (TGS5); high molecular weight-melanoma associated antigen (HMWMAA); o-acetyl-GD2 ganglioside (OAcGD2); tumor endothelial marker 1 (TEM 1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen NY-BR-1; uroplakin 2 (UPK2); adrenoceptor beta 3 (ADRB3); pannexin 3 (PANX3); G protein-coupled receptor 20 (GPR20); lymphocyte antigen 6 complex, locus K 9 (L Y6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2; Melanoma-associated antigen 1 (MAGE-A1); ETS translocation-variant gene 6, located on chromosome 12p (ETV6-AML); sperm protein 17 (SPA17); X Antigen Family, Member IA (XAGEI); angiopoietin-binding cell surface receptor 2 (Tie 2); melanoma cancer testis antigen-1; melanoma cancer testis antigen-2; Fos-related antigen 1; tumor protein p53 (p53); p53 mutant; prostein; survivin; telomerase; prostate carcinoma tumor antigen-1; melanoma antigen recognized by T cells 1; Rat sarcoma (Ras) mutant; human Telomerase reverse transcriptase (hTERT); sarcoma translocation breakpoints; melanoma inhibitor of apoptosis (ML-IAP); transmembrane protease, serine 2 ETS fusion gene; N-Acetyl glucosaminyl-transferase V; paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B 1 (CYPIB 1); CCCTC-Binding Factor (Zinc Finger Protein)-Like, Squamous Cell Carcinoma Antigen Recognized By T Cells 3 (SART3); Paired box protein Pax-5 (PAX5); proacrosin binding protein sp32; lymphocyte-specific protein tyrosine kinase (LCK); A kinase anchor protein 4 (AKAP-4); synovial sarcoma, X breakpoint 2 (SSX2); Receptor for Advanced Glycation Endproducts; renal ubiquitous 1 (RU1); renal ubiquitous 2 (RU2); legumain; intestinal carboxyl esterase; heat shock protein 70-2 mutated (mut hsp70-2); CD79a; CD79b; CD72; Leukocyte-associated immunoglobulin-like receptor 1 (LAI R 1; Fc fragment of IgA receptor; Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); immunoglobulin lambda-like polypeptide 1 (IGLL 1), MPL; Biotin; c-MYC epitope Tag; CD34; LAMP1; TROP2; GFRalpha4; CDH17; CDH6; NYBR1; CDH19; CD200R; Slea; Fucosyl-GM1; PTK7; gpNMB; CDH1-CD324; DLL3; CD276/B7H3; IL 11 Ra; IL 13Ra2; CD179b-IGLII; TCR-gamma-delta; NKG2D; CD32; Tim1-/HVCR1; CSF2RA; TGF-betaR2; TCR-beta1 chain; TCR-beta2 chain; TCR-gamma chain; TCR-delta chain; FITC; Luteinizing hormone receptor (LHR); Follicle stimulating hormone receptor (FSHR); Gonadotropin Hormone receptor; CCR4; GD3; SLAMF6; SLAMF4; HIV1 envelope glycoprotein; HTLV1-Tax; CMV pp65; EBVEBNA3c; KSHV K8.1; KSHV-gH; GAD; PDL1; Guanylyl cyclase C (GCC); auto antibody to desmoglein 3 (Dsg3); auto antibody to desmoglein 1 (Dsg1); HLA-A; HLA-A2; HLA-B; HLA-C; HLA-DP; HLA-DM; HLA-DOA; HLA-DOB; HLA-DQ; HLA-DR; HLA-G; IgE; CD99; Ras G12V; Tissue Factor 1 (TF1); AFP; GPRC5D; Claudin18.2; P-glycoprotein; STEAP1; Liv1; Nectin-4; Cripto; gpA33; BST1/CD157; low conductance chloride channel; the antigen recognized by TNT antibody; CD229; Toso; and BAFF-R;

wherein the method does not comprise the expansion of the starting population of T cells in the presence of SARS-cov2 specific peptides or peptide libraries.

17. A composition for the treatment of cancer and/or autoimmune disorders generated by the method of claim 1 or 16.

18. A method of treatment of cancer and/or autoimmune disorders comprising administering to a subject in need thereof an effective amount of a composition of claim 17.

* * * * *